United States Patent 9,675,668 (MODIFIED POLYNUCLEOTIDES ENCODING HEPATITIS A VIRUS CELLULAR RECEPTOR 2) - sequence listing, part 4

SEQ ID NO: 2975 - DNA, 3304 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaaggtaaggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcaaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaa

SEQ ID NO: 2976 - DNA, 3654 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttc

SEQ ID NO: 2977 - DNA, 3297 bp, Homo sapiens
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcaaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttc

SEQ ID NO: 2978 - DNA, 2106 bp, Homo sapiens
agccgcgggcgggcgcacggcgggcggacagcatgctgagcctcctcgtctggatcctcactctctccgatactttctcccaagtccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcgga

SEQ ID NO: 2979 - DNA, 7361 bp, Homo sapiens
acgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagaagttatcaaggaggatgctgctgaggggctttcttcacccacagactcctcgagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgttt

SEQ ID NO: 2980 - DNA, 3765 bp, Homo sapiens
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagatgctgtggagcagacagttgtgaccgagaccgaattggcatttccaagtcagtgttagttgccatgttgatggagagctgagaaaagccattttaatggcatttgcaaataagcaggacatggaacaggccatgactccctcagagatgcacattcacttgggttatctgcctcgaaggactgaaaatggcaaatattcaaaacttcagcaaccagaggtactggccttcatgagacaacggaatgggtagttgaaacattaaagagcaaacaacagtacagtcacttctgctcctctgaaatgaagacggcctcacatatccctttggaaacaatcaagtgtgcttctcatgactaaaggttaaagctgtaagactgttggcatttactgaactgactgtgacattagtaataaatataaaaaatagatatttagttgaaagggtaattcatcttgattgagccaattgtgttctatgttgtaggacatgctgcttccctgctttcttaatgttaagtacacattccatttgtatgggatttttattcaaatagtcctattaaagtatgcacttttgttgggaaaaaacaaa

SEQ ID NO: 2981 - DNA, 7190 bp, Homo sapiens
acgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgttt

SEQ ID NO: 2982 - DNA, 7304 bp, Homo sapiens
acgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgttt

SEQ ID NO: 2983 - DNA, 7248 bp, Homo sapiens
agggcacgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggttgggagaccgtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 2984 - DNA, 3465 bp, Homo sapiens
agaatatggccgccgggtgtggtgagggcgacgcgcttgcagtcgccgtctcttgcttccccgtcctctgacatcgcctgcagccgagcgggcccgttccgccggagctgaggaccagtatggaaccacccctttagtttgggctgcacgaaagggtcatttggaatgtgtgaaacatttattggccatgggagctgatgtggatcaagaaggagctaattcaatgactgcacttattgtggcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcaggaagaaaatgctggccttgagatagatagctcttcagaggatccagattaaactaagttcgagtcacttctcacagttgacttcctcaccaaataat

SEQ ID NO: 2985 - DNA, 5261 bp, Homo sapiens
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatcta

SEQ ID NO: 2986 - DNA, 5170 bp, Homo sapiens
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatct

SEQ ID NO: 2987 - DNA, 4792 bp, Homo sapiens
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatct

SEQ ID NO: 2988 - DNA, 5137 bp, Homo sapiens
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatct

SEQ ID NO: 2989 - DNA, 4640 bp, Homo sapiens
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaaattccagactaccttggttgacatgatttactttcttcatggaaatatggaagtcaatgtcccttccctggcagaagttcagttactgctctacacaacagtgaaagtcatgggtgactctggccatgaccagtgccagtcgctagtccttctgaacacccacattgcactggtgaaggaagactgtgttttttatccacgcattcgatctcgaaacatacctcctccgggtgcacaatttgatgtgatcaaatgccatgctttaagtgaattcaggtgtgttgttgttccagaaaagaaaaatgtgtcaacagtagaactagtcttcttacagaaactcaaaccttcagtgggttccagaaatagtccacctgagcaccttcaggaagccccaaatgtccagttgttcaccaccccattgtatcttcaaggcagtcagaatgtcgcacctgaggtctggaaacttactttcaattctcaagatgaggctctttggctaatctcacatttgacaagactctaaggaggagacttttaaagatgcactacatgttttttgagatcattaataaaataagcattgtgaaaacagtcaaggcaatatgaatatctccgtgtagctaattgaattggaactggaaaaatgcagacctctaaaattgaaaatgtaaatattttaaatatctacaataaaataaaaacagctaatagcagagccccaataaaatatctttatcatcaccttgcttcattttcttgaaactcaggcttgtaaatttgtgcctgcttcattatttgtgaggtgattaaagcatttctgattgtt

SEQ ID NO: 2990 - DNA, 3406 bp, Homo sapiens
ctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 2991 - DNA, 2719 bp, Homo sapiens
gcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgcaattcaggactcggaagtgacatcactcatctggtctcaggggcagcccagaagtatctgactgtagacacaactaggctccgtgggcatatctgggtggcaatttcagagggcagaggggacaccttcattgcctctcctcgcacagaaatggtgggctctctctggcccagcgtggtggttcatgcctgtaataccagcgttttgggaggctgagatgggaggattgcttgagcccaggaggtcgaggctgcagtgagctatgatcacaccaccacactccagcctgagcagcagagcgggacctcgtctctaagaatagaaagaaagaaagagaaacggtgtcctccgcacagccggtcagaactgtgtgactcacttgaggcaggaccgagagtgacatccagttgcacctttctcacctactttgggacctttgggggtgagttcccctttgtcctctcgtggaaacagcacacagcaagcaaccacaaaaccagagcggaaggagggacttcccaccggcatccggccccagtgccatgttttatcatctggaacggttgtgaagctttgtgtgacttgctcaggatcagcagtcaccatggtctaatcccaagagggactcgtcacccagagacctcaaaaggccccaggcctactgtggttttttctgagaggctcccagaaccaagtggcacgttggtttcctgtgcgtctgtgtctttgtgcctgtatctcgctgggggacttcacaggaagcaggatttgggcattcctgaagctcccagctggacaccactcctgagcgccacatcccatgatcacttcaaccacaggcctttgactttgccacatggcaaggcacccagcagaagatgaggatgacgggtgatgctagatggatgtgtacctggtggatggcccacgcacgaagactcaagaccctcaggactggccatataatctgcaaggtccagtatgaaataagaataagcagcccacacaactgggcatagtggttcatgcctgtaatcccagcactttgggaggctgaggagggtggatcacttgaggccaggaattcgagaccagcctggccaacatggcgaaaacccatctctactaaaaatacaaaaattagttgggcatggtggcacacacctgtaatcccagctactcggaggctgaggcacaagaattgcttgaacctgggaggcggaggttgcagtgagctgagataacgccactgcactccagtgtaggcaacagagtgagaccctgtctc

SEQ ID NO: 2992 - DNA, 6138 bp, Homo sapiens
cgcgctgccccctttaccccgggccgcgccccggggccccgcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaatttttcttgcttctctatttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtgggcctccttcagcctgggagggtctgagaataagatctagtgacccccatttatatcaaacctgataccttacacatgggcttctttctagattcttctttccatagctcatggagctgcagggaaagctttaagagctttggtcatataaaacatccattcagctgggcgcgatggctcatgcctgtaatcccagcactgtgggaggctgaggcgggcagatcacctgaggtcaggagttcgagaccagcctggccaacatggtgaaaccccgtctctactaaaaatataaaaattagtcaggcgtggtggcaggcgcctgtaatcccagctactcagaaggctgagacagaagaacagcttgaacccaggaggctgagattgcagtgagccgagatcgcaccactgcactccagcctgggtgacaagagtgagactctgtctcaaaaaaacaaaacacaaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagatggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtgggtttgggaattggagctcctccaaggagctcctcctaagattgagtgctgcagctgtagtggctgctggttgggagagtaagtgccatcactaatttaaaagtccttgccatctggaatcaggctttgtcaacagcagctgagaaaagcagcctgtgcctctgctggccaggcctaggccctcgtcagagcgtgcctctccacaaggcacttgggcctgggtgattgttgcgcctctggctttggcgtttcctctttgcagcactttgcctacctcccccaagccctgagccactgcctgctggggctcctactgaggttctggaaacacctctgcacctgccgcccctgggaggaaagagggccacacaggaagtgtctgcagggagaggtggcactcggcagcctgagttcaggagaggtgcttggagcttcaggcagaggggccttcagaggagggaaacggagcaatgtgtcacaggcaggcaggggcaggactgccaccccaggccccgtgggaggcctgctgagggcacagagctgctcggtgcagccttcatgctttgatctggaaagagcagctgtccgcaggcctctgtctccaagaggcctgtcacacaggaggaccgctggaaacataccaacacgtgcagtctcccctccaagctattcatgctgtttgtggaatctctctcaaacataagtgtcaggtgtgtgtcgtcccaacgggtcctgtgctgtgaatagatccatgtgcagcacaaagggaatgtggcacgtggccccaggaagagttcacccggccagggggcagttgttcagttgcctggggctgacactgaccactggcctctggggtgtcctgcagcccaaatgcccaccttgccctcctcacatctcagtcaggggaggccatgcccaagccaatgtgctgtcacagcctgcagcgggggcagcacttcctcggagggcctgggaggtgctggggatgccccagcgcttctcttcctgcctcgccctggcatggcccagcgcctctaggatcaacttacgatccgtggagcagccccgggaaacccaaatctggctcaggacagcgtacgggcaggagggctgtaaatcatcccaggctaagcctccgtgggcactggctcctgccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaacgagaaaaaatgttatttttactttctggaaaaaataaatattctcattgttgtagaaaga

SEQ ID NO: 2993 - DNA, 6182 bp, Homo sapiens
cgcgctgccccctttaccccgggccgcgccccggggccccgcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaatttttcttgcttctctatttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtgggcctccttcagcctgggagggtctgagaataagatctagtgacccccatttatatcaaacctgataccttacacatgggcttctttctagattcttctttccatagctcatggagctgcagggaaagctttaagagctttggtcatataaaacatccattcagctgggcgcgatggctcatgcctgtaatcccagcactgtgggaggctgaggcgggcagatcacctgaggtcaggagttcgagaccagcctggccaacatggtgaaaccccgtctctactaaaaatataaaaattagtcaggcgtggtggcaggcgcctgtaatcccagctactcagaaggctgagacagaagaacagcttgaacccaggaggctgagattgcagtgagccgagatcgcaccactgcactccagcctgggtgacaagagtgagactctgtctcaaaaaaacaaaacacaaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagatggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtgggtttgggaattggagctcctccaaggagctcctcctaagattgagtgctgcagctgtagtggctgctggttgggagagtaagtgccatcactaatttaaaagtccttgccatctggaatcaggctttgtcaacagcagctgagaaaagcagcctgtgcctctgctggccaggcctaggccctcgtcagagcgtgcctctccacaaggcacttgggcctgggtgattgttgcgcctctggctttggcgtttcctctttgcagcactttgcctacctcccccaagccctgagccactgcctgctggggctcctactgaggttctggaaacacctctgcacctgccgcccctgggaggaaagagggccacacaggaagtgtctgcagggagaggtggcactcggcagcctgagttcaggagaggtgcttggagcttcaggcagaggggccttcagaggagggaaacggagcaatgtgtcacaggcaggcaggggcaggactgccaccccaggccccgtgggaggcctgctgagggcacagagctgctcggtgcagccttcatgctttgatctggaaagagcagctgtccgcaggcctctgtctccaagaggcctgtcacacaggaggaccgctggaaacataccaacacgtgcagtctcccctccaagctattcatgctgtttgtggaatctctctcaaacataagtgtcaggtgtgtgtcgtcccaacgggtcctgtgctgtgaatagatccatgtgcagcacaaagggaatgtggcacgtggccccaggaagagttcacccggccagggggcagttgttcagttgcctggggctgacactgaccactggcctctggggtgtcctgcagcccaaatgcccaccttgccctcctcacatctcagtcaggggaggccatgcccaagccaatgtgctgtcacagcctgcagcgggggcagcacttcctcggagggcctgggaggtgctggggatgccccagcgcttctcttcctgcctcgccctggcatggcccagcgcctctaggatcaacttacgatccgtggagcagccccgggaaacccaaatctggctcaggacagcgtacgggcaggagggctgtaaatcatcccaggctaagcctccgtgggcactggctcctgccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaacgagaaaaaatgttatttttactttctggaaaaaataaatattctcattgttgt

SEQ ID NO: 2994 - DNA, 1422 bp, Homo sapiens
atggcgccgccagccgcccgcctcgccctgctctccgccgcggcgctcacgctggcggcccggcccgcgcctagccccggcctcggccccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaa

SEQ ID NO: 2995 - DNA, 1508 bp, Homo sapiens
cagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttcagagaatggtatgttttcttaactataggttattttatagagaatataaaagtataaaacattaaaaataaccctagatatactttaaaataatgttatatttatgctaaaatatgtaaattacactatacaaccatatgataggttatttctctaaccttgtcttctaacgttttaccaaaaattcataatctaatagtttatcagttttcaatagattaaataaaatgattactttaaaaataataaaatttatctaatttaaagttgatattatttttggccgttagttatctattactagtgatcagttatactgttttctatagctactttatttaacagcacagatttctatgcacctttactctttcctcaacccttgtctctatctgtacataattgctttgtcttgatgtttctatcaactatatcatgactatctattggttccataactctgtatcatgtgtattttcttattctggtataccacaaatgattcatgcaaatgaatttttggtgattgaaaaatattaaattcccaatttaaagtattatatgata

SEQ ID NO: 2996 - DNA, 1034 bp, Homo sapiens
ttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttcagagaatgaatctcactgtgttgcccaggctagagtgcggtggtgcgatttcagctcacagcaacctctgcctcct

SEQ ID NO: 2997 - DNA, 2016 bp, Homo sapiens
gatcaagcgccttcctttcccttcctctccccacttggcctttgccctaagccaagacctggccatcagcctggctgcaggggcctgcagagccagctgcactttttcaggtatgggggagggccaggcaccatgaagccagtgtgggtcgccacccttctgtggatgctactgctggtgcccaggctgggggccgcccggaaggggtccccagaagaggcctccttctactatggaaccttccctcttggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaatta

SEQ ID NO: 2998 - DNA, 2552 bp, Homo sapiens
gctgtggctcctctctcaggggacagcgtaggccctgggggtcagttggagagggctctgactaccagcgactgctctgggggtgtctgcgatcaaggacgatcctgggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaattaaaaaaaaaaacacttgtaatctcacccctcctaaagttaatgttaagattttgctgtatataatgaatgtatattatgaattatttacaaaaatggcatcatagtatacaaactgttgtgacttgattgtttatcactctaaaatctgtccagaaatattactttaatgttcaaatgattgccatctcagcactgtcccatacctgatagataaaatcaatctggctgggcacagtggctcacacctgtaatcccagcactttgggaggctgaggctggtgaatcacttgaggccagaagtttgagaccagcctggccaacatggttaaaccctgtctctactaaaaatatagaaactagctgggcatggtggcgggcacctgtaatcccatttacttgggaggctgaggcaggagaatcgcttgaacctgggaggtgaaggttgcagtgagctgagatcacaccactgcactccagcctgtgcaacagagaaagactccgtttcaaaagagaaaagaaaagaaatctatagataacaatccttccaggttgtaaatattattagccaaccacagaaaagcatgaagtgggtaccaagtaaatgagcacgtacactcttctgacactttagtctgaatttagtctgacaactctgactaaattcaacttactttagtcaatgaaatacctcaaagaaatattacatgtttattttttatttatcttctaggtaactcaatatcgtcttttttataataaagattcattttactcttaactatgttaaaatgctaaaattaattaatttccatttatttggggataaaacatggcttaagaac

SEQ ID NO: 2999 - DNA, 4755 bp, Homo sapiens
cggaaggacgggagggcacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaatctgatataaactaaaagggataatattttagaatatgggcttatatgtggtttttttttttggttatgaattacagtaaatctcccaggccttcagatttctacataatggaagaatatgtttttaaccctgagatcaagtttagtaggcaggacttgatctcaagtggtcacaaagttttctaaaaaaaaatagaaaattatgatgggatcaaataaggagcaagtgtcaaattccagccaacaggcagatctgcaggcagagctacaaactctgcagccaggaatggggaccagtgagagagtgtgggcgggggggtgggtgtcagagtcgtaggcactccaacagcagaggagactcccgctcacatgaggccagccgtaccccagtggacagcaggctccttctcactgttgtagacacttgctctccttgcagcatgctgcccccgcccttgccgccaactctgccgtgagatggacctaataggaaataggaaagaaagcctgacaagcctgcttcacaggaaatctgatttgtccttcactgagctcatcttttgcttctttgagtaaaacctggctttactaactattgtcacaaagtggatcttcggctgtggatgagtgtgaaaaacagaaaaaatataaaatccacaaaatcttgtgaaaattaagcatttgggggaaggtaaggcataggtgagtcagtccaatgaatacaatggtcaacataagtaagctctttgaacctatttattttctatttattattatttttattttttatatcttggccactctagccatctcctggcaggggtagtgtggcacagcatggccctatttaatttcttagtcaataatccatcacatagtctcttttagatattaacctaattaaggcaagcaggtagatggatgagtacccaagccgagagaagagtttaaatcaagccttctgtaaataaaatgtggtttaaagatatttttattgaagtgaaacacagtaatttcaaagaggttacgtaatagggagaaaggatgggaaataaccactttgtgctggattgaatgctatatatttacattagctcagttaaaaaaaatagtcttagaaagtgaatattataacccctgtttaaaaataagaaaactgagtcttgggaaagttaagtagcttgacctgagattcacagtttacaactacaaaactcatatactatattttataacacactgtctcttactcttactatttaaaaaaaagagattgttttaaaaattgattcatttaactcagtgaatgaagttgaagataaattcacaacagaaccattgatttgaactcagtgaatataaaatgtttaactttattctttagatcttagctttttacttttcacattcctttggtaattattctgtatcttaatttttaaaaaaatcatgtgaatggacagacagatagatggacagtatgaccgatagacagacctgtccctgagtgtgagtgtatgtagaagagtccccctgtcaagttatgttataaaagttcatctgaggtcagatattgggaataaagtttcatttttccatcgaaacaatcacgtaatgttagttggggtgctggtcaaacgcatagaagcctatgtaattctcagtgtagcttccctataatgtcattttggtacgaaagaacttaaaccctgagaaaaaaactgtagctcagtctccacctaagtaactggagcatgtgcccacttctgtgcccccaatccgcaatctccttccccagttccaggggcctgctgggattggctgcagtggaagaggctctttgagctgggagaagggtttatgcagaaagtggggctagaaggctttggctggatctctggaggggagggagttccatggtggctggaaatctccaaagctggtttcataaaatagcatgcaagaaaaaaacccaagtcttcaagaatagccatcactaggaaacagtatggtagctctactaaaagaaaagtaatgccaacatgaaaaacaacccctagattggagagcaacatttcactttatatgtctttcttctgagccctgcccctattacattctcagcattccagtctttctccatagaagtctctcagcaaatgctctttttttgaaatgctttaaatgtatactttgagacggaggtttgagctgagtactgctgtggaaagctcctgctcaattcaaaacacagaccggggggatgtctttagagtcaggagaaaacatcatgtgccaagggtgctctccaaactgatgactagttcccagacttaacagaggtcaagcggagaaaaaggaaaactttctttagagaagaaaaagaaaaatcttatcacttctcatatttctttaggcagtgtatgagcttatttgctgatatcactaatcctgagatgaaaaacaggatggacttaagtaatttttaacctatttctgaggccaaaaagactgtagtattattttaatcaaatttatgcattttcagtgggacttcaaattttaataataaggcaatacttttatcttcttaaagtatatttcctgtacttataagtgtgcaaatgacataattttaaaattagttggaatattgaaaaaaattaaaatttcacttgtaaaataa

SEQ ID NO: 3000 - DNA, 1179 bp, Homo sapiens
ggggtattgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 3001 - DNA, 587 bp, Homo sapiens
gagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctg

SEQ ID NO: 3002 - DNA, 521 bp, Homo sapiens
ggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtca

SEQ ID NO: 3003 - DNA, 655 bp, Homo sapiens
caatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtg

SEQ ID NO: 3004 - DNA, 4226 bp, Homo sapiens
ggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtagtatgaactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgctttttctttctttctttttttttttaagagacagagtcttgctgtgttgcccagtctggagtgcagtggtggcatgatcttgcctcactgtaacctctgcctcctgggttcaagctgttctcatgccccattctcccttgtagctgggattacaggcttacaccatcgcacttggcaaatttgtgtatttttagtagagacaggaattcaccatgttggccaggctggtcttgaactcctgacttaaagtgatccacctgctttggcctcccaaaatgctaggattataggtgtgagccactgcaccgggccatgtgctactttttcttccttccatccttcctcccttcttcagtgtaaatatgagattaatttgtgataccttactttaaagaacttagagttcagtaaaggaagcaggtatagaaagtgctatgataaagctatacataggatggtatagaaccacagactaggggcacttaaaatgggcaagaaaatagcctttgtaaataaaatagaggcaagagatataatgctttacctgcaaagagctataaatacagccatgtaccatataatgatgtttcagttagtgaaggaccacatacgagggtggtcagaacagcaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatagtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaatatttcaacaaacaataaaatgggatatttggggaagaaagttgtctcagggctctccaaagaagcagaa

SEQ ID NO: 3005 - DNA, 7834 bp, Homo sapiens
ggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaaagacaaaaaaaaaaaaaaagaaaagaaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctttttacaatccagagacagaaaacaaaatctagatgcaacagcgaaacaaagaacccatttccttcctggcaccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaatgacaaga

SEQ ID NO: 3006 - DNA, 7819 bp, Homo sapiens
ggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacatcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaaagacaaaaaaaaaaaaaaagaaaagaaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctttttacaatccagagacagaaaacaaaatctagatgcaacagcgaaacaaagaacccatttccttcctggcaccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaatgacaaga

SEQ ID NO: 3007 - DNA, 5789 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3008 - DNA, 5479 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 3009 - DNA, 5744 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3010 - DNA, 5672 bp, Homo sapiens
aactgtgttctatgtggatccagcattacaactgataaggggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 3011 - DNA, 5382 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 3012 - DNA, 5585 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagagctactcttaggccagatagcctgagcagacagacatgatgtgagttgtccaaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 3013 - DNA, 5918 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3014 - DNA, 5023 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatggagcaaaaagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 3015 - DNA, 5254 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 3016 - DNA, 5293 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 3017 - DNA, 5164 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 3018 - DNA, 6302 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3019 - DNA, 6173 bp, Homo sapiens
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3020 - DNA, 5879 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 3021 - DNA, 2692 bp, Homo sapiens
gatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccagcaacctacagagagacaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 3022 - DNA, 4278 bp, Homo sapiens
tttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctggctatgaagataataagccatttatcaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 3023 - DNA, 6176 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacagagtagaccagaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 3024 - DNA, 6058 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacagagtagaccagaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 3025 - DNA, 4284 bp, Homo sapiens
ttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagattt

SEQ ID NO: 3026 - DNA, 4816 bp, Homo sapiens
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 3027 - DNA, 4838 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 3028 - DNA, 4962 bp, Homo sapiens
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 3029 - DNA, 4935 bp, Homo sapiens
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 3030 - DNA, 4982 bp, Homo sapiens
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 3031 - DNA, 4843 bp, Homo sapiens
aaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagactttttttttttta

SEQ ID NO: 3032 - DNA, 5009 bp, Homo sapiens
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 3033 - DNA, 4758 bp, Homo sapiens
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 3034 - DNA, 5069 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 3035 - DNA, 5042 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 3036 - DNA, 6767 bp, Homo sapiens
ttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaagaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactat

SEQ ID NO: 3037 - DNA, 4789 bp, Homo sapiens
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 3038 - DNA, 6297 bp, Homo sapiens
agaaagcggacaggagggcgacttttctccgtcaggctggaactggtgccgctggaggcgggagcgggctggaggacggacagggtctggaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactat

SEQ ID NO: 3039 - DNA, 4731 bp, Homo sapiens
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 3040 - DNA, 2297 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacagagtagaccagaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggtcttgcaagtttgtctaccagtaagagagcaaagtttccttcctttcttctctttcttcattttctttttttcttttttgccttttattcctttaaaatttcgcctggcaaaaaataaataa

SEQ ID NO: 3041 - DNA, 6124 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgt

SEQ ID NO: 3042 - DNA, 2066 bp, Homo sapiens
aaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgc

SEQ ID NO: 3043 - DNA, 1836 bp, Homo sapiens
agtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaa

SEQ ID NO: 3044 - DNA, 2172 bp, Homo sapiens
gtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttagagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgcaaaactaaaaatgaggccaggcgcagtggctgacgcctgtaatcccagaaccttgggagaccaagattggaggatagcttgagttcaggagttccagaccttcctgggcaaaatagtgagactctgactctacaaaaaatttaaaaattagcagggcatggtggcatgcgcctgcagtcccagctactcaggaggccgaggtgggggaattgcttgagcccaggaggttgaggctgcagtgagctaggatcacgccactgctctcctgcgtgggcaacagaatgagaccctgtctctaaacaaaaatattttttaaagaaactaaaaatgaaatttgagtctcagcttctaggcttatgtactcccatccctgatactacacgttgttctgtttgcatgtttgttactgcagcatcaacataacatgactaataatgatgacagttctaccttttgttgacagacctcattgtttc

SEQ ID NO: 3045 - DNA, 1376 bp, Homo sapiens
gatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcactt

SEQ ID NO: 3046 - DNA, 2172 bp, Homo sapiens; identical to SEQ ID NO: 3044

SEQ ID NO: 3047 - DNA, 1800 bp, Homo sapiens
cttggagcctctaaggagatgaaactgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctca

SEQ ID NO: 3048 - DNA, 1515 bp, Homo sapiens
gagaggagaatggcggcggaaggctggatttggcgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctc

SEQ ID NO: 3049 - DNA, 2397 bp, Homo sapiens
atgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 3050 - DNA, 2020 bp, Homo sapiens
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagaggcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagct

SEQ ID NO: 3051 - DNA, 1400 bp, Homo sapiens
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccaggcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccac

SEQ ID NO: 3052 - DNA, 1008 bp, Homo sapiens
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttga

SEQ ID NO: 3053 - DNA, 1163 bp, Homo sapiens
atgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccag

SEQ ID NO: 3054 - DNA, 1873 bp, Homo sapiens
agatagagggagaggacagtgccaaaacccagctcctggccagtccccagctcctccctgcctggccctatcccaggatcccctccccggcctcccagctatgatctaccccggggcccagacttcaggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctcccca

SEQ ID NO: 3055 - DNA, 1706 bp, Homo sapiens
ggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcaggtgaggatcccactggacaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctc

SEQ ID NO: 3056 - DNA, 1263 bp, Homo sapiens
gatctaccccggggcccagacttcaggcgccttcacgatgccggcggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcaggtgaggatcccactggacaggtaagagcagaagggcagtgatgaataaatcaccctcagcacaccttctaaagagcactggggtggcgtcagccacttcaccacatgacctgggcttctgtgacccttgggagaagtcatgtctgccttgagacttgcaagtctcaaatgggataaaacaagagaagctttgatttcagtgctggccacataagtgcccctagctgtgagttgcgggacaagtggaagacagacagcaaagaggggcatttaggaaaatggagcaaagaaatgtgacaccatggagagtccacggagggtcccacagcgggaaagctgagggcaaccagagcgtgggagtccttgaatgccaggaccttggtctggtttctgaggaggagagtgacatggtcagagctatgctggaaaggtggccactgtgcagttgctactaccagtagcagctgtgctctgggggcctaagagtgtcagatggtctgctgccatggctctagcccaggatgttttgggatcgtccagttctgccacaggggcctgcctctgactgagtgtgaggttcaaccctcaccacccacccgtctacctgtcaaccctcacacctttcctaggaagtaagcaagacaagcatcagacggtggcccaaagtcacccctcttgcctcggtgggatatcatggcggtta

SEQ ID NO: 3057 - DNA, 689 bp, Homo sapiens
aaaaagggactggttgctagtggaaacctcagagtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactacgtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaac

SEQ ID NO: 3058 - DNA, 831 bp, Homo sapiens
aaaaagggactggttgctagtggaaacctcagagtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactacagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaac

SEQ ID NO: 3059 - DNA, 741 bp, Homo sapiens
gattctaccatcagaaaagaggccaaacttctatcatcatggtggatgtgaagtgtctgagtgactgtaaattgcagaaccaacttgagaagcttggattttcacctggcccaatactacagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 3060 - DNA, 929 bp, Homo sapiens
agtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaagagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 3061 - DNA, 786 bp, Homo sapiens
agtggctctgcggggaattgtgaggcggactgcgagggaaagggggccttgttgagtccgccaggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 3062 - DNA, 812 bp, Homo sapiens
aaaaagggactggttgctagtggaaacctcagagtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaac

SEQ ID NO: 3063 - DNA, 2958 bp, Homo sapiens
cggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacggatgtttcttgcc

SEQ ID NO: 3064 - DNA, 1306 bp, Homo sapiens
ttcagctgggacaaggacccagctatcgtaattcctaatccaggatttggatacccttacattttgctgtctgcattttaaaagtgccttccttagatgacatctttctaatccccacccttggcttggtaatgctttactccctccaaatgttgtgagtagtctctttttgtattcctttctcaacccacacttaatttcctctgtgtttcttttcttggtctcagtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcag

SEQ ID NO: 3065 - DNA, 555 bp, Homo sapiens
gagttaagcagggaaggcccatttgatcccgttttacagacgaggagacagaggttcagagtggttgagttgcccaagaaacttgagctaatcattttcagctgggacaaggacccagctatcgtaattcctaatccaggatttggatacccttacattttgctgtctgcattttaaaagtgccttccttagatgacatctttctaatccccacccttggcttgtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcct

SEQ ID NO: 3066 - DNA, 4972 bp, Homo sapiens
atgaggcaagtgctgtggttgtgtaatgtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggccccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaagccaggctctcccggctctcgctggcgctgccgccgctcacgctcacgccattcccggggccgggcccgcggcggcccccgtgggagggcgcggacgccggggcggctggcggggaggccggcggggcgggagcgccggggccggcggaggaggacggggaggacgaggacgaggacgaggaggaggacgaggaggcggcggcgccgggcgcggcggcggggccgcggggccccgggagggcgcgagcagccccggtgcccgtcgtggtgagcagcgccgacgcggacgcggcccgcccgctgcgggggctgctcaagtctccgcgcggggccgacgagccagaggacagcgagctggagaggaagcgcaagatggtctccttccacggggacgtgaccgtctacctcttcgaccaggagacgccaaccaacgagctgagcgtccaggccccccccgagggggacacggacccgtcaacgcctccagcgcccccgacacctccccaccccgccacccccggagatgggtttcccagcaacgacagcggctttggaggcagtttcgagtgggcggaggatttccccctcctcccccctccaggccccccgctgtgcttctcccgcttctccgtctcgcctgcgctggagaccccggggccacccgcccgggcccccgacgcccggcccgcaggccccgtggagaattgattccccgaagacccgaccccgctgcaccctcagaagaggggttgagaatggaatcctctgtggatgacggcgccactgccaccaccgcagacgccgcctctggggaggcccccgaggctgggccctccccctcccactcccctaccatgtgccaaacgggaggccccgggcccccgccccccagccccccagatggctcccctgacccccctgaccccctcggagccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaa

SEQ ID NO: 3067 - DNA, 2129 bp, Homo sapiens
ctctgatgccctcctcccttcgcctcctcagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacacacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacagaaatggcaggggaggaggctgatgctttaaatgaagaggatggtggggttgggaggtataaccctgctcctctctcccagtctgtgcaataaaggtcgtgaagatctctc

SEQ ID NO: 3068 - DNA, 2635 bp, Homo sapiens
gcatttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgccgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacacacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacagaaatggcaggggaggaggctgatgctttaaatgaagaggatggtggggttgggaggtataaccctgctcctctctcccagtctgtgcaataaaggtcgtgaagatctctcagccaggg

SEQ ID NO: 3069 - DNA, 834 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcatttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtgga

SEQ ID NO: 3070 - DNA, 2112 bp, Homo sapiens
aaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaa

SEQ ID NO: 3071 - DNA, 1901 bp, Homo sapiens
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatgg

SEQ ID NO: 3072 - DNA, 917 bp, Homo sapiens
gcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctctccaccaactaccttgggacaaggcgctgaatgaaccatggagcggatggcattgtcctgcagtcgtatagtatagcagtgcaggaacaaacagcacttgccagcatggcacacatgtgggaactgcagacattcctctcacagctag

SEQ ID NO: 3073 - DNA, 1389 bp, Homo sapiens
aaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccactt

SEQ ID NO: 3074 - DNA, 2123 bp, Homo sapiens
cgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacaggtatgggccaggggcagatatccagaagttcatggtgagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgtt

SEQ ID NO: 3075 - DNA, 3379 bp, Homo sapiens
ttgtgtcctctaaggggacgggttcatctgagtaaacataaaccccaacttgtgccattctttataaaatgattttaaaggcaagaagtgtgtgtgtcagagggtgggggagattcttaaattagattacctgcatgcctgctctccagtctcattcctgggtcaagactcaggtttccagctcagcaatccatcagcattatacagatccaacccaccctcacccgacccctgcagtttctccccaggtggagcagtccctcagtgaggactgtgaacgaatcttcaggaacccccactgtaggagcctcaaactgagccccacgggagatgctctagactgagaacttcccataaatgatacccacggggaacgtttagatttagaggttgcacagaattgctccacatctgggagaccaaaagacagtcctctggaaggtggctggcccaagctccccagtgggggaatcaggatgtcagagagatcctctagaacctgctgttcttgctattgcatgacccctccctggcaccagagcctccctcctggctccctcccctgtcacttgccagcctgtagtggtgcttgctgcagccctccctggttgctttatttatttattttgcaccaacagggttgctgcagactcattcttgcctggtttaaaaagagagagagagagagaggaaaaaaaaaaaggagaaatgctttctggctcttttctccacctcagtcttggcagcagcggccgcagcagcaacagcagcagcagcagcggcaggcagcagccgggcagccaggcagcgggggttgaggcacacagggaaggtgcaggggcctgaggtgcagctcgaatgggacagggcccccagcgctggacagatgcagtgccaaacttgatgccaccttccagcttctccggactgaagagggaatggatgcagccacagctccaaagcaagcctggcccccatggcccccgctccttttcctcctcctcctacctggagggagcggtggcagctgccctgctgtgtgtgactgcacctcccagccccaggctgtgctctgtggccacaggcaactggaggctgtacctggaggactcccactggacactgagctcctggacctgagtgggaaccgcctgtgggggctccagcagggaatgctctcccgcctgagcctgctccaggaattggacctcagctacaaccagctctcaacccttgagcctggggccttccatggcctacaaagcctactcaccctgaggctgcagggcaatcggctcagaatcatggggcctggggtcttctcaggcctctctgctctgaccctgctggacctccgcctcaaccagattgttctcttcctagatggagcttttggggagctaggcagcctccagaagctggaggttggggacaaccacctggtatttgtggctccgggggcctttgcagggctagccaagttgagcaccctcaccctggagcgctgcaacctcagcacagtgcctggcctagcccttgcccgtctcccggcactagtggccctaaggcttagagaactggatattgggaggctgccagctggggccctgcgggggctggggcagctcaaggagctggagatccacctctggccatctctggaggctctggaccctgggagcctggttgggctcaatctcagcagcctggccatcactcgctgcaatctgagctcggtgcccttccaagcactgtaccacctcagcttcctcagggtcctggatctgtcccagaatcccatctcagccatcccagcccgaaggctcagccccctggtgcggctccaggagctacgcctgtcaggggcatgcctcacctccattgctgcccatgccttccatggcttgactgccttccacctcctggatgtggcagataacgcccttcagacactagaggaaacagctttcccttctccagacaaactggtcaccttgaggctgtctggcaaccccctaacctgtgactgccgcctcctctggctgctccggctccgccgccacctggactttggcatgtccccccctgcctgtgctggcccccatcatgtccaggggaagagcctgaaggagttttcagacatcctgcctccagggcacttcacctgcaaaccagccctgatccgaaagtcggggcctcgatgggtcattgcagaggagggcgggcatgcggttttctcctgctctggagatggagacccagcccccactgtctcctggatgaggcctcatggggcttggctgggcagggctgggagagtaagggtcctagaggatgggacactggagatccgctcagtgcagctacgggacagaggggcctatgtctgtgtggttagcaatgtcgctgggaatgactccctgaggacctggctggaagtcatccaggtggaaccaccaaacggcacactttctgaccccaacatcaccgtgccagggatcccagggcctttttttctggatagcagaggtgtggccatggtgctggcagtcggcttcctccccttcctcacctcagtgaccctctgctttggcctgattgccctttggagcaagggcaaaggtcgggtcaaacatcacatgacctttgactttgtggcacctcggccctctggggataaaaactctgggggtaaccgggtcactgccaagctcttctgacctttccttccccagtggggaacccaccaagtccgcttcagataccaaaggggaagacagaaccaaggctgcttgaaccagaacctagtcccgagcagcaccgctctcctgcacctcccgcctgcgttgtgcctcctgccggagagtctgcttcctgagcttttccggtctgaggatagcattgtcatttcttctctgagggtcccagggagctgcagatgcagaccccgtcgttagtccagcccctgcttcaccccctccacacacaaaacaggaaacataatcaaagcgctagtcagctagtctaaccactaggctttcttcacacatgcttatatcctttaataaccaattgccaaccacggctataagattatttcagaggtggggctgggaagtgccacttgctccttagagtctgtttgtcaaccaggcagagtccctttcttttctgctccccaccccaaccctgcccctatgtacaggaataagagcaaaggacccacaggctacagagaagaggatggggacagagtgtgggatggagaggacagaccatatactgcactgtgtttgcatgagcctctaccaccttcctctatctaccagatcattaaacctgctgtcaaagggccacaacagtagcagccaaaactaaa

SEQ ID NO: 3076 - DNA, 5883 bp, Homo sapiens
acactcatgctgcagccttgagccgtccctcgtcctcctctcaggctccctcttgtccacggcgggcgggcgccgagctgctggctatgccactgaagcattatctccttttgctggtgggctgccaagcctggggtgcagggttggcctaccatggctgccctagcgagtgtacctgctccagggcctcccaggtggagtgcaccggggcacgcattgtggcagtgcccacccctctgccctggaacgccatgagcctgcagatcctcaacacgcacatcactgaactcaatgagtccccgttcctcaatatctcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagcctcgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaacctccaggtcctccggctgtatgagaacaggctcacggatatccccatgggcacttttgatgggcttgttaacctgcaggaactggctctgcagcagaaccagattggactgctctcccctggtctcttccacaacaaccacaacctccagagactctacctgtccaacaaccacatctcccagctgccacccagcgtcttcatgcagctgccccagctcaaccgtcttactctctttgggaattccctgaaggagctctctccggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaacgtcttccgcatgttggccaacctgcagaacatctccctgcagaacaaccgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtccccgaggtgcctagttacccagaaacaccatggtacccagacacacccagttaccctgacaccacatccgtctcttctaccactgagctaaccagccctgtggaagactacactgatctgactaccattcaggtcactgatgaccgcagcgtttggggcatgacccaggcccagagcgggctggccattgccgccattgtaattggcattgtcgccctggcctgctccctggctgcctgcgtcggctgttgctgctgcaagaagaggagccaagctgtcctgatgcagatgaaggcacccaatgagtgttaaagaggcaggctggagcagggctggggaatgatgggactggaggacctgggaatttcatctttctgcctccacccctgggtccatggagctttcccgtgattgctctttctggccccagagaaaggtgagcctacctcttcctgacttgcctgattctcccgtagagaagcaggtcgtgccggaccttcctacaatcaggaagatagatccaactggccatggcaaaagccctggggatttccgattcatacccctgggcttccttcgagagggctcttcctccaaatcctccccacctgtcctccaagaacagccttccctgcgcccaggccccctccgggcctctgtagactcagttagtccacagcctgctcacttcgtgggaatagttctccgctgagatagcccctctcgcctaagtattatgtaagttgatttcccttcttttgtttctcttgtttgtgctacggcttgacccagcatgtcccctcaaatgaaagttctccccttgattttctgctcctgaaggcagggtgagttctctcctcaaagaagacttcaaaccatttaactggtttcttaagagccgtcaatcagcctggttttggggatgctatgaaagagagaaggaaaatcatgccgctcagttcctggagacagaagagccgtcatcagtgtctcacttgtgatttttatctggaaaaggaagaaacaccccagcacagcaagctcagccttttagagaaggatatttccaaactgcaaactttgctttgaaaagtttagccctttaaggaatgaaatcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaatctaccaccaatcccgatcggctcttattagctccccgctccacaagacacctgtgacatcctccagggccacaggagcacgtgctgaccagttttcccttccagttcctgcacaaaaagtgtccagagggctgtttgcaaacactagtgcactttgtagcttttcaccctctgtcccagggaatctaggagagatgaggcccgtcagagtcaagagatgtcatccccccagggtctccaaggcatttccacactattggtggcacctggaggacatgcaccaaggcttgccagagccaacaggaagtgagcccagagcatggcacatgagcatcacccgctgatggtggcctgctgtgcctggtgccaacaggggcatcccggcccgtacccctccagacaggaagcatgggtttgcccacagacctgtcgggtgctcctgtgagtggcctccagatgtctttgtgcataggcacaagtgggccagggctggagggaggtgggaaacctcatcatccggtgggccctgccaatcttaacccagaacccttaggtattcctggcagtagccatgacattggagcaccttcctctccagccagaggctgacctgagggccactgtcctcagatgacaccacccaggagcaccctaggtgaggggtgagggcccccttatgtgaacctcttgcctcttcctttctcccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacatgtata

SEQ ID NO: 3077 - DNA, 3248 bp, Homo sapiens
cagccttgagccgtccctcgtcctcctctcaggctccctcttgtccacggcgggcgggcgccgagctgctgatgtgtccctagcataacctggccccattcctttgcatctagatgcctttggacaaggctatgccactgaagcattatctccttttgctggtgggctgccaagcctggggtgcagggttggcctaccatggctgccctagcgagtgtacctgctccagggcctcccaggtggagtgcaccggggcacgcattgtggcagtgcccacccctctgccctggaacgccatgagcctgcagatcctcaacacgcacatcactgaactcaatgagtccccgttcctcaatatctcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagcctcgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaacctccaggtcctccggctgtatgagaacaggctcacggatatccccatgggcacttttgatgggcttgttaacctgcaggaactggctctgcagcagaaccagattggactgctctcccctggtctcttccacaacaaccacaacctccagagactctacctgtccaacaaccacatctcccagctgccacccagcgtcttcatgcagctgccccagctcaaccgtcttactctctttgggaattccctgaaggagctctctccggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaacgtcttccgcatgttggccaacctgcagaacatctccctgcagaacaaccgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtccccgaggtgcctagttacccagaaacaccatggtacccagacacacccagttaccctgacaccacatccgtctcttctaccactgagctaaccagccctgtggaagactacactgatctgactaccattcaggtcactgatgaccgcagcgtttggggcatgacccaggcccagagcgggctggccattgccgccattgtaattggcattgtcgccctggcctgctccctggctgcctgcgtcggctgttgctgctgcaagaagaggagccaagctgtcctgatgcagatgaaggcacccaatgagtgttaaagaggcaggctggagcagggctggggaatgatgggactggaggacctgggaatttcatctttctgcctccacccctgggtccatggagctttcccgtgattgctctttctggccccagagaaaggtgagcctacctcttcctgacttgcctgattctcccgtagagaagcaggtcgtgccggaccttcctacaatcaggaagatagatccaactggccatggcaaaagccctggggatttccgattcatacccctgggcttccttcgagagggctcttcctccaaatcctccccacctgtcctccaagaacagccttccctgcgcccaggccccctccgggcctctgtagactcagttagtccacagcctgctcacttcgtgggaatagttctccgctgagatagcccctctcgcctaagtattatgtaagttgatttcccttcttttgtttctcttgtttgtgctacggcttgacccagcatgtcccctcaaatgaaagttctccccttgattttctgctcctgaaggcagggtgagttctctcctcaaagaagacttcaaaccatttaactggtttcttaagagccgtcaatcagcctggttttggggatgctatgaaagagagaaggaaaatcatgccgctcagttcctggagacagaagagccgtcatcagtgtctcacttgtgatttttatctggaaaaggaagaaacaccccagcacagcaagctcagccttttagagaaggatatttccaaactgcaaactttgctttgaaaagtttagccctttaaggaatgaaatcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggc

SEQ ID NO: 3078 - DNA, 5815 bp, Homo sapiens
atgcctttggacaaggctatgccactgaagcattatctccttttgctggtgggctgccaagcctggggtgcagggttggcctaccatggctgccctagcgagtgtacctgctccagggcctcccaggtggagtgcaccggggcacgcattgtggcagtgcccacccctctgccctggaacgccatgagcctgcagatcctcaacacgcacatcactgaactcaatgagtccccgttcctcaatatctcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagcctcgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaacctccaggtcctccggctgtatgagaacaggctcacggatatccccatgggcacttttgatgggcttgttaacctgcaggaactggctctgcagcagaaccagattggactgctctcccctggtctcttccacaacaaccacaacctccagagactctacctgtccaacaaccacatctcccagctgccacccagcgtcttcatgcagctgccccagctcaaccgtcttactctctttgggaattccctgaaggagctctctccggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaacgtcttccgcatgttggccaacctgcagaacatctccctgcagaacaaccgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtccccgaggtgcctagttacccagaaacaccatggtacccagacacacccagttaccctgacaccacatccgtctcttctaccactgagctaaccagccctgtggaagactacactgatctgactaccattcaggtcactgatgaccgcagcgtttggggcatgacccaggcccagagcgggctggccattgccgccattgtaattggcattgtcgccctggcctgctccctggctgcctgcgtcggctgttgctgctgcaagaagaggagccaagctgtcctgatgcagatgaaggcacccaatgagtgttaaagaggcaggctggagcagggctggggaatgatgggactggaggacctgggaatttcatctttctgcctccacccctgggtccatggagctttcccgtgattgctctttctggccccagagaaaggtgagcctacctcttcctgacttgcctgattctcccgtagagaagcaggtcgtgccggaccttcctacaatcaggaagatagatccaactggccatggcaaaagccctggggatttccgattcatacccctgggcttccttcgagagggctcttcctccaaatcctccccacctgtcctccaagaacagccttccctgcgcccaggccccctccgggcctctgtagactcagttagtccacagcctgctcacttcgtgggaatagttctccgctgagatagcccctctcgcctaagtattatgtaagttgatttcccttcttttgtttctcttgtttgtgctacggcttgacccagcatgtcccctcaaatgaaagttctccccttgattttctgctcctgaaggcagggtgagttctctcctcaaagaagacttcaaaccatttaactggtttcttaagagccgtcaatcagcctggttttggggatgctatgaaagagagaaggaaaatcatgccgctcagttcctggagacagaagagccgtcatcagtgtctcacttgtgatttttatctggaaaaggaagaaacaccccagcacagcaagctcagccttttagagaaggatatttccaaactgcaaactttgctttgaaaagtttagccctttaaggaatgaaatcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaatctaccaccaatcccgatcggctcttattagctccccgctccacaagacacctgtgacatcctccagggccacaggagcacgtgctgaccagttttcccttccagttcctgcacaaaaagtgtccagagggctgtttgcaaacactagtgcactttgtagcttttcaccctctgtcccagggaatctaggagagatgaggcccgtcagagtcaagagatgtcatccccccagggtctccaaggcatttccacactattggtggcacctggaggacatgcaccaaggcttgccagagccaacaggaagtgagcccagagcatggcacatgagcatcacccgctgatggtggcctgctgtgcctggtgccaacaggggcatcccggcccgtacccctccagacaggaagcatgggtttgcccacagacctgtcgggtgctcctgtgagtggcctccagatgtctttgtgcataggcacaagtgggccagggctggagggaggtgggaaacctcatcatccggtgggccctgccaatcttaacccagaacccttaggtattcctggcagtagccatgacattggagcaccttcctctccagccagaggctgacctgagggccactgtcctcagatgacaccacccaggagcaccctaggtgaggggtgagggcccccttatgtgaacctcttgcctcttcctttctcccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacatgtata

SEQ ID NO: 3079 - DNA, 3609 bp, Homo sapiens
aaaacaaagtgaaatgtaatcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcacagagctctatttgattgagaacaaggttactatcttacataataacggttttggtaacctctccagtctagaaattttaaatatctgtagaaactccatctatgtaattcaacagggtgcatttttaggcttaaataaactaaaacagttatatctctgccaaaacaaaatagaacaactgaatgctgatgtatttgtgcctctaagaagcctaaaacttctgaatctgcaaggcaatttgattagctatttggatgtaccaccactatttcatctggaattaataactttatatggaaacctatggaactgctcttgcagtctatttaatttgcagaactggttgaacacatcaaatgtgacattagaaaatgagaacatcaccatgtgtagctaccccaacagcctgcagagctacaatatcaaaacagtacctcataaggctgaatgccactcaaaatttccttcatcagtaactgaagatctttatattcattttcagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatgaattatgtgaagaaaattaatttctttcaaagtttgctttttaaagcaaagttatcagctcactcagtttagatatggagattttgctatgtgacataacaaaatacagctggcaggcattcatattaatgacaacatacatgaatatcataaaattatgttctttgcattatattgagcaagcaggttcaaatacagtaactgacactcctcggtagttgacagttacatagtctacaatactagcactactattcttagcagtgcttgggtgaccatacgaactagtaaaaaggtctaaattattcatgaattaaaatgaatggattctcatattaacacaggtatttgacataatatgtattaagttatactaatgtttcaatcagtaaagaaataaaagtttaggatttattaatatatggaagtcaaagtgaggaacagagatagcttaaataatacactaagattgattttatgctcccagaataaaatcatagagttggaaaatatttttttgaaatgcttcctgaaatagcacaataaatttccttaaaatttcatagcaatttaaagcacaagcacaatgttcaggcataatccctaataagtcactattgattctggttataaagaaaggctgtcaccataatgcaggatcactacagtttaatgtcatactggcttccaaagtgggcatcacaattatctataaatcttgttttaaaaatacatatttccacctctctctgggagatttttattcaaattggtctgtgctgacactaaggaatcttcatgtggtccatggacagctatttctatctattcagtagatagagcaatgtttcccaaattgtttttctagaatactaatttccagagagacattcacaagtatttacagaagaagaaggaggtacatggtcaaattactacaggaaaaactagtagtttaaacaaggtgaaacaagattctttttcttttttttttttttttttttgagacaaagtctcgcactgtctcccaggctggactgcagcagcgcagtctcagatcactgcaacctccgcctcctgggttcaagcaattcttctgactcagcctcccgagtagctgggagtacaggtgcacaccaccatgcctggctaatttctgtatttttagtagagacagggtttcaccatgttggccaggctggtctcgaacgcctgacctcatgatctacccgcctcggcctcccaaagtgctgggattacaggcatggagcaccgtgcctggccaagattctttacaataggatttatgtaaaactttactaagctaaactgctctctgattattcaagagcaaagtattaaaaatttctcaaacttacttgacaacaaaacccattctttcagttacatctactaagagctcgtagttcaataacattccaaagaacgtagtttggaaaacactggcctatcggctgtaataggaagggtctaaagaaaattatttgctgagtcctcataatcaattggctataatcacaatttaataatttatcaatgcaaacagtacattaaaaactgtagcacaatctataatttttaccttcatatgcagagaaattaagaatttacatcttttacaaatatgtatatctctgaaataatgaaatatattgatgggtgaaataatatttctggtattttcttcattataacacgtggaatggaacagtggctagaggtatggatggagcaaggtcaaatatgagctgatggagctgggagctaaataagggtataatatgctacttctgtgtatgttgtgtatggtatagtatgctatttctgtgtatgttcaaattgtttatgtatataataaagttttaaaaatttgtatgtacttgacaattccttagaaaaaagaggctaaaataaaatagatctatgtcataatctatagaatagtcattttaaaagttacataattagtaaattcaatacaaatgtctactgagagaaaataaaaactaggatgatatacctgtaaaatagaagaacttactaatttataatacatatttgcttgtgtttacagacacatgttttcaacaaaggatataagtatattatggctaatgtttctttatatatcaattatactttgttttaaaccttaattataagaatgagatgattataggaacataaaatatctttttctaaacaatgtatcattctgctaaattatttcctaattataagatgcaaatattaatatttgagaaatgtagcaaaatgaaatataattgcaaatgagcaaagactacacttaagcttttatattcaagggcctctgttgaatatggggtattcaataaatatctgactacacaaagaaaaataaa

SEQ ID NO: 3080 - DNA, 1731 bp, Homo sapiens
ctgctcgggcccggccgccacctgcacggcgggggagccgctcgccgcgggagcgtcaggagggcacgcgtctgcggctgaaccgcggaagggccggtgaggaaccgggcctcgggagatggccctgagggcccccgcactgctgccgctgctgctgctactactgccgctccgcgccgccggctgcccagcagcctgccgctgctacagcgccacggtggagtgtggcgccctgcggttgcgcgtcgtcccgctgggaatcccgccagggacgcagacactgttcctgcaggacaacaacatcgcccgcctagagccgggagccctggcgccactcgccgctctgcgccggctctacctgcacaacaacagcctgcgcgccctggaggccggcgccttccgcgcgcagccgcgcctgctggagctggcgctcactagcaaccggctgcgcggcttgcgcagcggcgccttcgtaggcctggcccagctgcgcgtgctctacctggcgggcaaccagctggcgcggctgctggatttcaccttcttgcacctgccgcgactgcaggagcttcacctgcaagaaaacagcattgagctgctggaggaccaggctctagcggggctgtcctccctagcactgctggacctcagcaggaaccagctgggcaccatcagccgagaggccctgcagcccctggccagtctgcaagtcctgcgcctcacagagaacccatggcgctgtgactgcgccctgcactggctgggtgcctggatcaaggagggcggccagcggctgctcacctccagggacaggaagatcatgtgtgcagagcccccgcgcctggcgctccagagtctcctggacgtatcccacagcagcctcatctgcattccgccctctgtccacgtgcagccgctggagctcacagccaacctgggtgaggacctgcgggttgcctgccaagcctccggctacccgcagccattggtgacctggagaaaggtgccccagcctcgcgagggccggccgcgagcccaggcccagctagaaggcgggttgctgggcctgggcggacactcggcatccgacacgggcagcggcatgctcttcctcagcaacatcacgctggcgcacgccggtaagtacgagtgcgaggcctccaacgccggcggcgctgcccgcgtgcccttccggctcctggtcaacgcgtcccggcagcagccgcagcagcccgcgcaaccgccgcctccggccgcccgccccgccggcagcgagccccggcccgaggcgggcagcatggccttccgcgccctgggcgtggccacacagacggccattgcggcggccatcgcgctgctggcgctcacggcgctgctcctggtcgccatgatctgtcgccggcgccgcaggcgaaaaaaggcgcgggggcctccgggggagggagcgctgttcgtcaacgactacttggacggcccctgtacgttcgcacagctagaggagctccgcgacgagcgcggccacgagatgttcgtcatcaaccgctccaagccgctcttcgccgagggtccggcggaggcgcccgctgactgcggcccggaacagggggcggggccgggactccgcgtgcccccgccggtcgcctacgagatccactgctagggccgcgggcgcgcggatgacgtgggcgccggagattggccggtgcggcctcgcgcatgctccgtcagtaa

SEQ ID NO: 3081 - DNA, 2529 bp, Homo sapiens
ccccgcccctcgcccgcgcaggccggagtcgcggcctccccagctagtggtcgcgggcgcggtcgcaggggcagcggggtggccgccgcgccaggcgtggagctgggtctggcgggctccgagaggcccgggagcggcgcgcagagcagcctccggccgccgccgcgcagagctgccagagtggactgcactgcttctcccagcggggcaggatggcggtttcatgtctggttggataaggccttgcctgcggaaaccagctccatccccaggccctagcagaggctcgcgtgtccccgtccccaggtcaggtcaggatgggcaccgtgcgcccacctcgcccctcgctcctgctggtctccacccgggagtcttgtctcttcctcctcttctgcctgcacctgggcgccgcctgcccacagccctgccggtgccctgaccacgcaggggctgtggctgtcttctgcagcttgcggggccttcaggaggtccccgaggacatcccggccaacaccgtgctcctgaagctcgatgccaacaagatctcccacctcccggacggggccttccagcacctgcaccggctcagggagctggatctgtctcacaacgccatcgaggccatcggctccgccaccttcgcgggcctggccgggggcctgcggctgctggacctgtcttacaaccgcatccagaggatccccaaggacgccctgggcaaactcagcgccaagatacgcctgtcccacaaccccctgcactgcgagtgcgccctgcaggaggccctgtgggagctgaagctggaccccgactctgtggacgagatcgcctgccacacctcagtgcaggaggagtttgtggggaagcctctggttcaggctctggatgcgggtgccagcctctgcagcgtcccccacaggaccacagacgtggccatgctggtcaccatgttcggctggttcgccatggtgatcgcctacgtcgtgtactatgtgcgccacaaccaggaggatgcccggaggcacctggagtacctgaagtctctgcccagcgcccccgcctccaaggaccccatcggcccggggccctagcgcctgttccggcagacccccgccggtggctgctgtcacttttgtagtaggtggtgactgatgctgcttttgctcttccctgaggcaggtgtcacagccatgtgtgctccccactgttgcactcaggcacagcagcacctccaggctgggtggttttgccacacatccgtgtgacggatgaggaacctgaagcttagaggaacggaatgactgcccgtgacgataccatcaggaaattatcccagtggaacttcaacccgggctgtccatcgtgacattccgcctccttccaccatgccagcctctcccacacggggccctgcaggctgtggatatgcactcagaggactaagggggtgctctgcaagcgagagggttcaccagagggagcttgggtgcaggttcacccgctgaaggcgctgataagtcctgtgctgaggagctgacttgcccttgtttacttacaaagtgcattgtaggtaaacatgagccttgttccagtgttcgaagtacattggaacgtaagccctgtttccagagcaaagtaacagagaccaggtttttctagagagctaagtgggatgtgtagctcaaacaaactgtcctacccttttttattctcaaatgtttgttttgagtaaccgtagtgccaaaatttcagttcagtaatggggtgaacaatatggagagagacctgggaaaagtccagggtagcttgcccaggggaagacagcagccacatacctgggggcccgcctgcttcctgcccctctgggtgtgcctgatgcgggaggccctgccccagggcgatctcagctcactgcaacctttgcctcccaggctcaatcacttctgctgcctcagcctccctagtagctggaattacaggcatgagccaccacgcctggctaatttttgtatttttagtagagaccgggtttcaccatgttggccaggctggtctcgaactgttggcctcaagtgatccgcccgcctcagcctcccaaagtgctgggattacaggcgtcagccaccgcgcccggccctgtgccttgctttttctactcactaagatataaaacagctctttttccaaggcccggagtactggggattgatgtttcaaggccaatcaatgggatgcttcgttttctccagcaacaggaactctctcttttcacctttgctgccaggaatctcagagataatttagtgctcaatttactaaccttacttcacattcaggttagatgttacctccacctatatgatagtaattcctaattttattttttattgtcctttttatgagtgtttatattttaaagtactttgagtatttttggggggggtgtaaatgagtgatcagtgtacattgtgtgtggactgaagtgtaggtatgtagagatgcttcgccaaacagatgcttaaaaatgaa

SEQ ID NO: 3082 - DNA, 1995 bp, Homo sapiens
ggagtcgcggcctccccagctagtggtcgcgggcgcggtcgcaggggcagcggggtggccgccgcgccaggcgtggagctgggtctggcgggctccgagaggcccgggagcggcgcgcagagcagcctccggccgccgccgcgcagagctgccagagtggactgcactgcttctcccagcggggcaggatggcggtttcatgtctggttggataaggccttgcctgcggaaaccagctccatccccaggccctagcagaggctcgcgtgtccccgtccccaggtcaggtcaggatgggcaccgtgcgcccacctcgcccctcgctcctgctggtctccacccgggagtcttgtctcttcctcctcttctgcctgcacctgggcgccgcctgcccacagccctgccggtgccctgaccacgcaggggctgtggctgtcttctgcagcttgcggggccttcaggaggtccccgaggacatcccggccaacaccgtgctcctgaagctcgatgccaacaagatctcccacctcccggacggggccttccagcacctgcaccggctcagggagctggatctgtctcacaacgccatcgaggccatcggctccgccaccttcgcgggcctggccgggggcctgcggctgctggacctgtcttacaaccgcatccagaggatccccaaggaccccatcggcccggggccctagcgcctgttccggcagacccccgccggtggctgctgtcacttttgtagtaggtggtgactgatgctgcttttgctcttccctgaggcaggtgtcacagccatgtgtgctccccactgttgcactcaggcacagcagcacctccaggctgggtggttttgccacacatccgtgtgacggatgaggaacctgaagcttagaggaacggaatgactgcccgtgacgataccatcaggaaattatcccagtggaacttcaacccgggctgtccatcgtgacattccgcctccttccaccatgccagcctctcccacacggggccctgcaggctgtggatatgcactcagaggactaagggggtgctctgcaagcgagagggttcaccagagggagcttgggtgcaggttcacccgctgaaggcgctgataagtcctgtgctgaggagctgacttgcccttgtttacttacaaagtgcattgtaggtaaacatgagccttgttccagtgttcgaagtacattggaacgtaagccctgtttccagagcaaagtaacagagaccaggtttttctagagagctaagtgggatgtgtagctcaaacaaactgtcctacccttttttattctcaaatgtttgttttgagtaaccgtagtgccaaaatttcagttcagtaatggggtgaacaatatggagagagacctgggaaaagtccagggtagcttgcccaggggaagacagcagccacatacctgggggcccgcctgcttcctgcccctctgggtgtgcctgatgcgggaggccctgccccagggcgatctcagctcactgcaacctttgcctcccaggctcaatcacttctgctgcctcagcctccctagtagctggaattacaggcatgagccaccacgcctggctaatttttgtatttttagtagagaccgggtttcaccatgttggccaggctggtctcgaactgttggcctcaagtgatccgcccgcctcagcctcccaaagtgctgggattacaggcgtcagccaccgcgcccggccctgtgccttgctttttctactcactaagatataaaacagctctttttccaaggcccggagtactggggattgatgtttcaaggccaatcaatgggatgcttcgttttctccagcaacaggaactctctcttttcacctttgctgccaggaatctcagagataatttagtgctcaatttactaaccttacttcacattcaggttagatgttacctccacctatatgatagtaattcctaatttt

SEQ ID NO: 3083 - DNA, 4207 bp, Homo sapiens
ggtggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcctgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccagaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 3084 - DNA, 2656 bp, Homo sapiens
ggtggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcctgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaa

SEQ ID NO: 3085 - DNA, 4311 bp, Homo sapiens
gtccgcagcagctctcccaggaccccactctgccagtaagtcagctgaggccgagaggagggagagaggacctcagaggccagactgtgagctagtctgccctgctcctgcgtgtgaggggtcgttggcagggcttagggaaggagaccttgatttggtatagtgggaacatttgctttggagacagatgaactggattctgatcgtgaccctgctattttctccttgtgtgactttggagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcctgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccagaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagc

SEQ ID NO: 3086 - DNA, 801 bp, Homo sapiens
gtccgcagcagctctcccaggaccccactctgccagtaagtcagctgaggccgagaggagggagagaggacctcagaggccagactgtgagctagtctgccctgctcctgcgtgtgaggggtcgttggcagggcttagggaaggagaccttgatttggtatagtgggaacatttgctttggagacagatgaactggattctgatcgtgaccctgctattttctccttgtgtgactttggagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatg

SEQ ID NO: 3087 - DNA, 2564 bp, Homo sapiens
cctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaaa

SEQ ID NO: 3088 - DNA, 5665 bp, Homo sapiens
tgggattataggcgtgagccactgcacctggcacaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagatctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcttccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggt

SEQ ID NO: 3089 - DNA, 5537 bp, Homo sapiens
ttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagatctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcttccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggt

SEQ ID NO: 3090 - DNA, 2654 bp, Homo sapiens
tttttcaatatcactcttcgtggattcttctttatattaaatatgttgtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccggaagttgggggcttattcagacttcttaaaagtctaccttcttcctctgtactttcagcccaaagtgagacttttgagttgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccacaggcttcaatgatacctttttcccacccctgtggtagtgttggctgcctcctttacctactcaagtaaccgctttaccgctaatttattgctctctgttttcatctataggatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctc

SEQ ID NO: 3091 - DNA, 2435 bp, Homo sapiens
cacagaaatttccaaggaaactatatttcttacattgatggaaatgtatggaaagcatacagttggaccgagaaactaattctcagagaaaataacttgactgaattacacaaggattcatttgaaggcctgctatccctccagtatttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctctcccttggttcatcaagcaccagtcatataataccacatacttgaactcctg

SEQ ID NO: 3092 - DNA, 3273 bp, Homo sapiens
attttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaataacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataataatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcagaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctctc

SEQ ID NO: 3093 - DNA, 5177 bp, Homo sapiens
agaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcacgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 3094 - DNA, 5818 bp, Homo sapiens
cttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcacgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 3095 - DNA, 3045 bp, Homo sapiens
ctaataaaggtgacataaataaaggtgtcataaagacagggcatggcacacgcttataaggggcatgagcatctcagggctgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatca

SEQ ID NO: 3096 - DNA, 3025 bp, Homo sapiens
cagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcatttttaatggt

SEQ ID NO: 3097 - DNA, 2764 bp, Homo sapiens
tcagggctgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatg

SEQ ID NO: 3098 - DNA, 3061 bp, Homo sapiens
aactaggaggatgacatggaggaggacgacgatgactccgattatccggaggagctggaagatgacgacgaggacgccagttactccacggaaagcagcttcagcagcactccagaaagtggtaaaatagctgtggagtgcagacccagtgaagagattgtagatgtcagatgggaagaactacacagtttaattcaagtcagttgctctcccctgaaggaagagtattctcggatttcacctcagaggaggaagaattcaggctgccagaactggactagcacttctgaagatcccaaggccagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatc

SEQ ID NO: 3099 - DNA, 2209 bp, Homo sapiens
ggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttcctgtccgggtaaaccctttggtgagtccctcgcccctccctccccgcccctcccctctccatccctgctgtcccggctccccagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggccttgatgaaatccagtgctccctgcccatggagagcaggaggatatccctgcgtgagctgtcggaggccagcttcagcgagtgtaggttcagcctgtcactcacagacctctgcatcatcattttctccggtgtggccgtgtccattgcggccatcatctccagcttcttcctggccactgtggtgcagtgcctccagaggtgcgcacccaacaaagatgcggaggatgaagacgaggacaaggatgactgagccacctcctccctcctgcctcttactctccagcaccgaaccagaagctctctccaagacgagagggaaatgctgaaaatggaaaagcactggccaccatctgtgaactgaacagagcctgttccgtgtcttggcccctgggtacacctgctgggaccactgatctcagagtttagaatcagcagagcacagaagcccaggaaggatggagggaattattcctggagcataacctgcctctcagatcgaggtgtgtgttgggggagaagatgaccgagtcaggcttcatagctgatgactaaaagcctcccccaggaaatgtgaagactggcagctttcaatggcaaagatgattttacgccattctttttctgacctgtactgggagatcatgaaacatctgccttcctcccaagaaacagcagctcaaacagtggagattcaaattcggatcattcaccacaagaacgagaactttgatccttatataataggcctcagcaaccttgggatgttatactgggaactaataaactcgtgtgcaatagactcaatgtttatgttcccccagattttatatgttgaaacctaatccccaatgtgatggtatttggaggtggggcttttgggaggtgattaggtttagatcatatcatgaggatggggcccaaatgatgggattagtgccctcatgaaaggtggccccagagagctccttcaccccttcaatgcttgaggatgcagcaagaaatcagctgcccatgaaccgagaagcaggccctcaccagaacccagccatgctggcacccagatctcagacttccagcctccagaactgggagaaataaataaatgtctgttgtttgtaa

SEQ ID NO: 3100 - DNA, 1696 bp, Homo sapiens
attgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 3101 - DNA, 489 bp, Homo sapiens
gaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatct

SEQ ID NO: 3102 - DNA, 1695 bp, Homo sapiens
ggaaacgcagagctaggaggtgtgggcctcgggtgaggggagacccagctcttagacctgggagcccagacagaggtggatctgcccaccttgcagctcccagaggactcctgctgccttgtaccagttgggaaaaagcaaaattcagagcagttcctttttctgggtccctcgccttggccacatcggaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtacctggatacctgaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 3103 - DNA, 927 bp, Homo sapiens
gggtacctgggggcgcgtggagacaaggaatggagccccggaatgccgggcccttgggtacttgggaaggcaggctgctgagtgcctgggatggggcgatcttcctccccagaagcaaacaaacctccccgcgagaatctgaatgcgttggcatcttgggtggtgactgaatggtcagatcgtggactagggatgcttctccaagctctaagaggaccatagtctgctctcttctctggcacccgcttgcttctacgctccttcacctctgcagccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaat

SEQ ID NO: 3104 - DNA, 1551 bp, Homo sapiens
atcagaaccacatcggaaatcaatgaaataagcattattcttagttctagttgaggaaactgacatgcggaacaattagttggcctgtccaagacctcctagctggtatcagaaatgaaagttgaacttgattttatctagcttcaggttctggatgatttctgtacattttgttgagaccaagaaagtttaaacggtccagggtggctccactggctcaaagggaaagaggatttagtaagtggcttgatttctcttctctgccttccattccactccacccccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 3105 - DNA, 878 bp, Homo sapiens
catagtcttccaaaatccagcaagaaaaatccttctcagaaaggtctccaatgcgtatgacctcatcttccttcgtatcctactgcactccaggactatgccaatttatggccatgctcccaacagcaggtcacctcctgcccctcctgctggtgataggcacagggggtactgtgcccagcccccaggtgcctccccggggctgttatgtggcaaaggaagcaggtgaacggacgttccgctgcagccaggcaggcctcagtgctgtgccctccggcatccccaatgacacccgcaagctctacctggatgccaaccagctggcatcggtgcctgctggtgccttccagcacctgcctgtcctggaggagttggatctgtcccataatgcccttgcccacctctcaggggcggctttccagggcctggagggcacattgcgccacctcgacctctctgccaaccagctggcctcagtgcccgtggaggcctttgtggggctacagatccaagtgaacctatccgcaaacccatggcactgtgactgcgccctccaggaagtgctccggcaggtgaggctggtgccgggcactgggacaggcatcgtgtgtggctcaggagcccgaccggacctcgtggggcaggagttcctgctgctggcaggggaggaagagctgtgtgggtcggggtggggtggggcccggaggagcaccgatgtggccctgctggtcaccatggggggctggctgacactcatggtggcttatctggtgcattatgtgtggcagaaccgagatgagaccaggcgctccctcaagcgggccccagtgctgcccgtgcgttccgaggactcctccatcctcagcacagtggtctga

SEQ ID NO: 3106 - DNA, 3828 bp, Homo sapiens
tccctcccctcccctcccctcccctctgccctccccgcccccaccacttcccccttttgttaattaaaactaagaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaacaaaaatattttctaacttgtaagttctatttaaagggggtgggggggaatcttgggaacgttgtggggtacaagccacaagttaacttgctatgctgccagaagggatttctggtataaggttgaaattgctgagataaaataaactaaaacaacaaacatccttaaagaggtagggtgtgggctgctgagggggcaagagggatagactgaatctgtcattttttagaagatgcttcataggacacaggactatccatttctacagacatctttcttaagccgagagctgtctttgcagaattatcttattaaaaaaaaatacaaaaaaaaagcaccatgaatttgtactgtgccaaaatgatagtggcaataatatttttcttcagaggctaaggggaagatagacctgtacatgtattttaagcaggaaaaccaccaaaattcaaacgaacccttaaaggggctgagtctttgtccatgtgcacaagtcttgggggtctgtgcactggacacacatgtgccttgcctgacagaattgcttagaaaggagcagagaaggacgggagctggcgtagctctcagtctaatgctttcacattgcaccagattcctgcagttgggcttaacccactctgcaaggcatgtgtctattcagggtttcccaggaggaggaggcccctgaaggggtgcggcagcaggggggtgggaagggagggtaaagcagagagaatgtattcacaggaggccataaattagcattgtgccatgtccacctgttgttcctggactctgacacatgattgtagacaatgatggcattttatgatttttaaaaaagattttgtttgttttaaggtggagagggaggagaagcctgaattggggagcttgggagtggaagcttttctcatgcttgtgatttggtgactcttctaaatgctgattcattagggattattacagcggatgtcaactggttgtggtgatggggtgggggcagaacatgagtagcaaagaaaagggagagacgaaaagggtacaggctcacgtaaagtaatgaagcctttcccaaccaggatggttcacaaaaaagctgtgagatccacagttacaagtgacacgcatgcacacatggagttccacatggggtactgttgaatggagcacactgatgggaagcttccctctcccaggccccctcaggagaaggtggaagagaaagggtgggcgtgggtggggaaggcagagatctctgttattctggtccatctaatgatgtaacttctttcagttattattttagctttaaaaggaaataaggggttcagatttgaaagggggtggtatgggtgggggaggggaattgccaacaaaagaacactgattgtaatgtgagaaaagtgtatttttgtattttaataaatattgttgaatttttaa

SEQ ID NO: 3107 - DNA, 561 bp, Homo sapiens
acattcacgttctgactgaaggacaaaaggatgagagagcagtctgcgtggctgccgcctgcaacaccgcgagcccggcgcgaggaggagacgaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacacctt

SEQ ID NO: 3108 - DNA, 451 bp, Homo sapiens
tggtcctcgggggccggacggagcgccgccccgcgtgccggcagccggcggactggagaactgaccccccgtttttgtctcttccaccctccgagaagaggcgaggagaaaggggaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctc

SEQ ID NO: 3109 - DNA, 2958 bp, Homo sapiens
cccgcagcgggccttgcaccccaaattcctgagcctcattgggggggtcctccccccacgggccgggcatgctgccccccggaaggaacccctctcctcgctccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgtggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaa

SEQ ID NO: 3110 - DNA, 1400 bp, Homo sapiens
cccgcagcgggccttgcaccccaaattcctgagcctcattgggggggtcctccccccacgggccgggcatgctgccccccggaaggaacccctctcctcgctccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggtggcctcaactccatccacgaacctctgctcttcaagagcggctccaaggagaacgtgcaagagacgcagatctg

SEQ ID NO: 3111 - DNA, 1369 bp, Homo sapiens
acttgcaaacgcagggaaagggtgagacctttcaaagctgccaagtgggcaagcttccagcagcagtctgggagcgagcgacagagccaccaagctgggcggcagggcattgagcctcgcgtttcaatttctgttcagttctcctgtaatggaaaattgctttgcacaaagctaaagtgttacagttctttccagagcccctcccccgccccacccccccaccggcagccttcggatcagaggacagagcccgcaggaaggtgaaaggagggtggttgtggcttcttactatgtcccttgcttcaggccctggccctgggtggttactcttttcctttggaatggggctggtatcagggtcaaagtgtccaaataattgtctgtgtcaagcccaagaagtaatctgcacagggaagcagttaaccgaatacccccttgacatacccctgaacacccggaggctgttcctgaacgagaacagaatcactagtttgccagcaatgcatctaggactcctcagtgaccttgtttatttggactgtcagaacaaccggattcgagaggtgatggattataccttcatcggggtcttcaaactcatctaccttgacctcagctccaacaacctaacctcgatctccccattcactttctcggtgctcagcaacctggtgcagctgaacattgccaacaaccctcacctgttatcgcttcacaagttcacctttgccaacaccacctctttgaggtacctggacctcagaaataccggcttgcagaccctggacagtgctgccttataccacctcactactctggagaccctgtttctgagtggaaacccctggaagtgcaactgctctttcctggacttcgccatcttcttaatagtgttccatatggacccctcagatgatctaaatgccacatgtgtggagcccacagagctgacagggtggcccatcacccgggtggggaacccactccgatacatgtgcatcacgcacctggaccacaaagactacatcttcctgctgctcatcggcttctgcatcttcgccgcgggaactgtggctgcctggctcacaggtgtgtgtgctgtgctctaccagaacacccgccacaagtcgagtgaagaagatgaggacgaggccgggactagggtggaagtcagccggcggatttttcaaacccagacgagctcggtccaggagttccctcagcttatttagttgccagagaccactatcttatgtgcctcccccaggctccctgctttctctcttgccctccccatcccaccaccttggagctgtcatagagattgaaaccttctagtaaaataaataaaatctctgatggccatttc

SEQ ID NO: 3112 - DNA, 5410 bp, Homo sapiens
ttctcaggttttgatcatcattccagaccctaggggacctcaactgggtgtcttgccccctaggctccggaaggggacctcccgtggatctcaggaagccctctggtgctcagaggctcctgggaaagtccctagccatgataccacatgctcagaagccccaccttcacagacgctggccccagatgtagctgccttcctgtgtcacagactctcgattccatggacacagtcctcatgggctccctccagcactgctgttgcctgctgcctaagatgggtgacacttgggcccagcttccctggcccgggccaccccacccagcaatgctgctgatctccctcctcttggcagccgggttgatgcactcggatgccggcaccagctgccccgtcctttgcacatgccgtaaccaggtggtggattgtagcagccagcggctattctccgtgcccccagacctgccaatggacacccgaaacctcagcctggcccacaaccgcatcacagcagtgccgcctggctacctcacatgctacatggagctccaggtgctggatttgcacaacaactccttaatggagctgccccggggcctcttcctccatgccaagcgcttggcacacttggacctgagctacaacaatttcagccatgtgccagccgacatgttccaggaggcccatgggctagtccacatcgacctgagccacaacccctggctgcggagggtgcatccccaggcctttcagggcctcatgcagctccgagacctggacctcagttatgggggcctggccttcctcagcctggaggctcttgagggcctaccggggctggtgaccctgcagatcggtggcaatccctgggtgtgtggctgcaccatggaacccctgctgaagtggctgcgaaaccggatccagcgctgtacagcagattctcagctggctgagtgccggggccctcctgaagtcgagggcgccccgctcttctcactcactgaggagagcttcaaggcctgccacctgaccctgaccctggatgattacctattcattgcgttcgtgggcttcgtggtctccattgcttctgtggccaccaacttcctcctgggcatcactgccaactgctgccaccgctggagcaaggccagtgaagaggaagagatctgacatgcctgcctctcatccctccatgctgctgaccgccacagctgctggccaccagacgccctccctgactgctcactctggttccatggtgacctggctgcctcagtcatggttcaagcaaggtggggacactcattttgtatgagcatctgctttgggccaggcggcacgctaggaattgggaacatcagatgaactgactcagtccctgccctcaaggcacttccctctggtcaaggagagagatccaaaaactattccctttaagactatatgtcaggactctgagcacgtcattatggaggcccagaggaggagccatcatctgtatctagcaatgtccatgagaattataagattagagtgatttgtgaactgggtcatcaggaaatatctactttgtcaggtaggcaaagaagggtgtctgcacatggcagaggccagaatatgcatagtgtgctgtgttgagaagagtgaacagttcctggtcacttacttgtatagagggggtgtggcacagaactcaaacctacccctcacctcctgacaccaaaactgtcagctctcagcaatgccagccactgcctacagggagtaagaacacctctatgacagcccctggcctccttccaccagcagctaccaggtgagaccacctcccagtgactgcccccatatgaccaaatgtcaccagttggtgaggtcccaggcagcaggctgaggatggacactttcaatgcccttgctcctgcctctcactcaagttttgcttcagaagagagaggcaggaggcccagcaactggggcagcaagagtcctggcaccttgggatcctaatcatgtgactgttcttgccacagtgctcatgccacagggtctcaccaggaaagtgcactgtgggccacagacccacagcctggcagcacccagagctaaaaggggacaaaggcagcacagttatgaccatatgaggctttgcattttcttctaagcaacttacccacgttaagcatgagggtgagagagctattaaatactaagcccttgccagtgtcaggtactttgaaaagctctctgcacaaaccattccctttgacacacacacacacaaatcttttgaggtgaacgctgttgttcccattttacggatgaggcaactaaggctcagagaggttaaagtcacatgccactatgagcaagataaagtctgtgctctttctactgccccatccaagttggggaacatcaccattccctctagagttatataaattcaaattcaactagagctgacaaagttcctcataaggtccaggcactcctctgggcacttttatatctattgactcacttctttcaattctcacagcaacactgcctggtggtttttattatccccatttgacagatgaattaatcgtagagagttgagtgacttacccaaggttgtctggataagccctagaaggaaggcggtaggcagctccattcagggaaactgcatctaatcagtcagtcaaaaatcaagtaactttacgagcaaagcacaattatcatcatcgtggtcttcttcatcagtttcgtcagcagcatcattatcttccctctatttgttcagcaccggatagttcatgagtatttttgcatcattctccttgacttttcacatccctgtgcaggaggtaaatcaaacatcagtaatcctgttttacagatggggaaaaaagtctcaaggttggatatgacttgctatgtggcaaggttggggctcaaccctaacacagttctctttccagtgctttctcaagtgcttggggaagagaatgcctcagaaggctgggtagtggggccctggaattcagcatccatgaatgtgctagtggataagctaaatagaaggcagccaaacccatctgctgtacagattgaactatgctcacggtagggcaaattgcaggctctgaaacagagactacacaggtaacacctgaataggagactcctgctttacaatgtgtagataaaacatcagcaatggtggccatggtggcagtcatgtgaaaagtaagatctttgggaatcaagaaaggaagctgtgttaaccactcctgctcaagccctgctgcgtgtgttgcaagagatactaagagagcaagaaagctataggtgagaacctctgcagtttaggagaagaacatcaaggcacagtccaacatgctgataagtctggccaggaggagaattaaaacaggggctttccacacctcccttgccccaagctccagcggtattctatcagcccatcctcctggaaagcctgaaaggaatgaaggaggctaataagtcatcttccaggaaggcatccctcactcgtgcttccctgagctagtcaaccaaaagagtcttcagaaactttgctagacctgaagtacttgaacctgtgtcccctgaatctttcttacaacatctgggacaaatccctggccctgtgacatccgaagcagaactgtgccctgctctctccttctgtgatgaccaaggatggtgaactcaagttgttctctacaagccaggccagcaacctaaatacttggagaggaacttttagaaactataatcctgacaaaatagaaaagtttcccataggggcataccataatactataataacctcccaggaactattgtttgccaaaatgtagttaatatattttaagatatatgcttttttgcataggactagaaccagaaaagacaccaaatgcccccttgacatcaatgtcctttctagtgggacaatttggtctccattaatgccaagcctttctgaacaggatacatggcttttaaaggacagatgtttctcctgctgctagaagttcctcagtttactagagcacaatgaggaaagtattcaacctccctactgccaaggaattccctgcttctcccccaccgccatcatcttgtccaagctatcagaagcaaccttctagagataatctaacaatcctgattagaattgctcccatatccctggtgaccacaggcttcattcaaattgtccaaactggttaacatgtatgtgatggggtatctctgcatctgtatgtctgtctgcgaggttccttgtatattggctgtccgctgacttgggacagatctctctagaacttgggttcagttctctgacatagtccactcagccataggctgagtggctaaatatgcataaataagcatgcctaaataggcatatataggttggtgcaaaagtaattgcggtttttgccattaaaaatgatagcaaaaatcccaattacttttgcgtcaatctaatattacattgcttgatagattaagatggaatcccaccaggtttagggtaggactggatgctcaaaaaataaagaaggagaaaaatctgtggcagaggcatcctaatgagaacctgacttctccttgcttccctctgctctctcctgcgcctcagagacttgtccccattgcagaagcttcctccatgctaggccagaggatatcaaagtttagtttggtcaagatttgggccaagaaaattcctttttagaagagccctcatatctgaatcacatcactttgggccagttatctctggtcaccctcagacaaaccctcgtctctttttctcccttcctagaggaattcccagggaactttgcagaaataggtctccagagttgctacagaggttcatggctcctttcgaggagggacatgtatgaaatttgaacagatcaagacaggtgtttgtcttcaaccatgggggaagacctccagcttccattttcccctatacgtgtctgtgctgacatcctttccagcagtagaagactaaaaagatatatcttaacccattcctcaaaaggacatcttcctaaagccagagaaaattgtctgcgcttccccaccccaggaagaggcaaaagggaagtgagggcgtcacaaggtcttttgtaaatcactattgtgtttgtcacagcactgggcggagagctggatccacagagctctcagtttttctaagcactgtcctgtaatgtgctaatgtctgggggtgggagggctggggaggggtggggttagagggaagatgccaacctttgtatggagatgattttataaccatgcacttttgtaactgtgcagaatttttcataaatgtacattaataataaagagtgtatagtttaacaaa

SEQ ID NO: 3113 - DNA, 2910 bp, Homo sapiens
atctcagtggtcgcggaaggtgacgtggacacggaagtggtcgtcgtcgcggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtgga

SEQ ID NO: 3114 - DNA, 3327 bp, Homo sapiens
aggcattatgaaaaacctctatttcagagtcattaccatagttataggtctttattttactggaataatgacaaatgcatcaagaaaaagcaatattttattcaattctgaatgccaatggaatgaatatattctgacaaattgttcttttaccggaaagtgtgatatacctgtggacatatcacagacagcagccactgtggatgtaagtttcaatttctttagagttctcttacagtctcacacgaaaaaagaagagtggaaaataaaacatctggacctcagtaacaatctcatatcaaaaataaccttaagcccttttgcatatttacatgctttggaagtgttaaacctcagcaacaatgccatccactccctctcattggatctactcagtcctaagtcctcatgggtgaaacgccacagaagcagcttcagaaacaggtttccattgctgaaggtgctcattcttcaaagaaataaactcagtgacactcccaagggactgtggaaactgaagtcattgcagagtttggatctgtcattcaatgggatattgcaaatagggtggtctgattttcacaactgcctgcaactggagaatctctgtttaaagagcaacaagatattcaaaattcccccacaagccttcaaggacctcaaaaaattacaggtcatagaccttagcaacaatgctctgattaccatcctaccaatgatgatcatagctctagaatttccccatctagtggttgacttggctgataataactggcagtgtgatgatagtgtggcagtctttcaaaattttatttctgaatcctggaggaaaaagtggaatgtcatttgcaacaggtctatagggagtgaggaggccaacgggggcactccccagagcaggatttccagggaaacccgccttcctcccattcatctgcatcgcatgaaaagcctcataaggagcaaagcagagaggccccagggaggaaggcacacgggcatttctactctggggaagaaggcaaaggccggctctggtctcaggaagaagcagagacggctgccaaggagtgttagaagcacccgcgatgtgcaggctgccggcaaaaaagaggacgctccccaggacctggctctggcggtgtgcctgtcagtgttcatcacattccttgtcgccttcagcctgggggctttcacaaggccttatgttgacagactgtggcaaaaaaagtgccagagcaaaagccctggcctggacaacgcgtattcaaacgagggcttctacgatgacatggaagctgcggggcacacaccacacccagagacccatctgcgccaagtatttcctcatctaagcctctacgagaaccagacccctttctgggtgacacagccacacccacacgccaccgtaattcctgatagaactctgggaaggagcagaaaggatcctggcagttcgcagagcccaggacagtgcggggacaacaccggggcaggaagtggaaatgatggtgcagtctattccattctccagagacatccacatgccggtaaccgtgaactaatgtcagcagcgcaggaccacatccataggaatgatattctcggagaatggacttatgaaactgtggcccaggaagagcctctcagtgcacattcagtgggcgtctcttctgtagctggcacgtctcacgctgtctctggctcaagccgttatgattccaatgaattagacccttccctctccggagaaataacagcttccctctgtaaaatgctaacacatgcagaagcacagaggactggagatagtaaggaaagagggggcactgaacagtcactttgggactcgcagatggaattttctaaggaaaggcaagtgagttcatccattgatttgctgagcatacagcagccaaggctgtccggggcaagggctgaggaagcgctttcagcccactacagcgaggttccatacggtgacccaagagacacaggcccatcagtctttcctccaagatgggacagtggcctggatgtcactcctgctaacaaggaaccagtgcagaaatccactccttctgacacttgctgtgagttggagagtgactgtgactctgatgaggggtctctgttcactctgagctccataagttcagagagtgcaaggagcaagactgaagaggcagtgcctgatgaggagtccctgcaggacgagagctcaggggcaagcaaggacaatgtgacggctgtagacagtcttgaggaaaatgttaccttccaaacaattccagggaaatgcaagaatcaagaagatccctttgaaaaacctctcatttctgctccagactctggcatgtacaagactcatctggaaaatgcctctgacactgatagatctgagggcctgtcaccctggcccaggtcaccagggaatagtcccttaggggatgagtttccgggcatgttcacttatgattatgacacagctcttcaatccaaggcagcagaatggcattgctcacttagagacttagaattttcaaatgtggacgttttacagcaaacaccaccatgttctgctgaagttccctcagatcctgataaggctgccttccatgaaagagactcagacattttaaaataagaatctttcattaaggaaatattcacagctctaaacaatattcttttaaagatcatggcaggggaaaactaaagccttcacaacaagatcctgaaggagacaacatgaattccaaccaagtggacactgatgcaaatgagggttttgtgggcccacttgagggcgatgattctagaagggttataagctaaacacacttgttaacatcctatggggatgaacctgctcttcagtgtgaaagagaaagaggggaatattttgagatcattccaagaaccatgcaccattattacaagagctccaaacaaaaccagttcactgagaacacaggagcacttcatcaataggttggggtaaatattcagaagagaatctgttgcagttagacgaagtggttctaactttccttctcaaatacagacctggagcaatctgatgggatttggctctctgaaaagaacagctttaggatgacaaagacaaggatgttcaacttgatcatcaaagagaattcaaatgacattttttcatacatattgaagcacttaagtggaaatgctggatagattttaatgaattctgaacacacactagcacaactttttggaggctgatcgtgaaactgcaaaattggaaaagttctgagtaaatataaatgtttttaaataagttatgtt

SEQ ID NO: 3115 - DNA, 2249 bp, Homo sapiens
acattgactgtaaaggaaccaatgtgaagagtggtgtttcctgagcaaacggtgacttaaaaaaaaaaaaaaaaaagtggtggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcagaatcaggctttcaacatcttgaaaaccttgcttgtttgtatttaggaagtaataatttaacaaaagtaccatcaaatgcctttgaagtacttaaaagtcttagaagactttctttgtctcataatcctattgaagcaatacagccctttgcatttaaaggacttgccaatctggaatacctcctcctgaaaaattcaagaattaggaatgttactagggatgggtttagtggaattaataatcttaaacatttgatcttaagtcataatgatttagagaatttaaattctgacacattcagtttgttaaagaatttaatttaccttaagttagatagaaacagaataattagcattgataatgatacatttgaaaatatgggagcatctttgaagatccttaatctgtcatttaataatcttacagccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaataatt

SEQ ID NO: 3116 - DNA, 3823 bp, Homo sapiens
aaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggcacatctccagacttcaatttggctgaaataattcatgccacggacctgtgcacatgcctggaattgagagacacagttaaaagactccaagttgctttctgccttttgaaaactcctgaaaaccatccctttggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcaaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaatgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttccttttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaagtttgttgtgtttaactcaccaacacgtggtgtataatgaagacagaactataataaattagttttgttctgattttttagaacacttgcaataatgtatcatttatagttcttgctagttgcagtggtaatatttttcacatccataaaaacaactaccaaaata

SEQ ID NO: 3117 - DNA, 5036 bp, Homo sapiens
gaacaggcacagggcctgcagctgcagcattcagtgcatcccagaccctccagaggcccagggcagggtcagatcagacagacctggcagcacagatgtgaagtgtaaacggcacacagccccctggacttgggttgattcttgtatcttgctgctcaccagctatgtgacttgagccaagttctttaacctcttcaggacctcagtctcttaatctgcaaactggaggtattagtgcttatctcatgtacctgttatgagagtcatatgaaaaaagacattcagagtcttcaaagagtcctgagcaatggtaggtgctcagtaagtgtttgtgcatttccttgacacttgtagctaaaaacttacctggaatcagacttccactcaggagtcagaccaggctcaagaaggcaacacagtctggcccctttttgtttccatctttggttctaggccaaggctggacttgcctcatggccctggcatctgagagagaaactggataggttcctcatgctcaggatggaggaaacagcagtggcttgcattgttgattgcaggggtgatgtctaatctcctgaagaaaggaactctggagtcacagagattgattcatacaatcaacacacactgggcacccatcccgtactacaggcacaagaggcaagacaggtctctagttagagacgttttcccacggtgtggtcagaactgtgacagtaggaagcatgagtactgcaagagcataaagccagccccttagtcagccaggtggggaggttttggagaagacttctgcaggtggtgactgaacttaaagttgagcgttgaagaacaagtaggagttgtctggaagacaatgaggaggagacatcagaaggggtggcatgtcacggtaacctcaacccaaaaggtttgtgtgcagcgggtaagtggggtggtgacaagagaagccaggtgaaggggccgggccaggtcacagaaggtcttacctgcacagctgaggagctcagacccaggcttcttaactccactgcctcctcctgggcaacactgccaggctgttgggaaaggagaaacactcctgcctccagggtggggaagttggcaaacaccaaagcaatatccccacccagaagatcctgggcagcagaacaccccagcctgcctggatgtgtcaggtctgctgcctttcacctctagggtcctggggagcccatcccagattttagaagctgtacttatttccaccaaccctcacccacctcccacctacactgccagaggaacttctggaaacttatcattttatcttccatttacccagtgagccaaggaggctgggaggaaagaggtaagaaaggttagagaacctacctcacatctctctgggctcagaaggactctgaagataacaataatttcagcccatccactctccttccctcccaaacacacatgtgcatgtacacacacacatacacacacatacaccttcctctccttcactgaagactcacagtcactcactctgtgagcaggtcatagaaaaggacactaaagccttaaggacaggcctggccattacctctgcagctcctttggcttgttgagtcaaaaaacatgggaggggccaggcacggtgactcacacctgtaatcccagcattttgggagaccgaggtgagcagatcacttgaggtcaggagttcgagaccagcctggccaacatggagaaacccccatctctactaaaaatacaaaaattagccaggagtggtggcaggtgcctgtaatcccagctactcaggtggctgagccaggagaatcgcttgaatccaggaggcggaggatgcagtcagctgagtgcaccgctgcactccagcctgggtgacagaatgagactctgtctcaaacaaacaaacacgggaggaggggtagatactgcttctctgcaacctccttaactctgcatcctcttcttccagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 3118 - DNA, 3211 bp, Homo sapiens
cagcagacggcagacggtgcccggcgcccacgggaagctgaagatacagcggtaaacaaacctccatgtctcaagctgaccacacttgtatctggacttgccagctgattagctctgttcccaccaggctcgttcaaagacccacagcttgagggggcagagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 3119 - DNA, 3463 bp, Homo sapiens
gggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacgggggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 3120 - DNA, 3099 bp, Homo sapiens
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaac

SEQ ID NO: 3121 - DNA, 3465 bp, Homo sapiens
gcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaa

SEQ ID NO: 3122 - DNA, 3725 bp, Homo sapiens
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctggg

SEQ ID NO: 3123 - DNA, 2692 bp, Homo sapiens
cgtcttgatgggaaaggaggagcaatgggaaagactggagtatctcagtccctctcagtggatgggggttgtgggagagaggcagctgggagacaggcctccctctggagttcatagctgagttgctgtccaaatcagtggtccctagaatctataaaacaaagctgagaacttcagaggtgcatccagagaagccacactccaaaaggaccacttccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaactgcaacttgagttccttccctccttggaccctggattcctcccaggtcctatcgatcaacctctttggcaaccccctcacttgcagttgtgacttgtcttggctcctcacggatgcaaagagaactgtcctaagcagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggccagacgctgggcctgcagcgctgcgacacgcacctggtggcctacaaaaacccggcctttgatgattacccgctggggctccagaccgtcagttagcccagcttctgggataacgcgtctcatcgaactggatctgagcgcaaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgcc

SEQ ID NO: 3124 - DNA, 1693 bp, Homo sapiens
agagtgacgtcaggggcgaggaaagaggcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 3125 - DNA, 1873 bp, Homo sapiens
gtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 3126 - DNA, 1459 bp, Homo sapiens
gtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataa

SEQ ID NO: 3127 - DNA, 554 bp, Homo sapiens
aggtgtcgtctcctgcccgcgaaacaccacccaccgttagtgtgggtccacaggtttcgagcccctgttgaaaatgtcagctctgtggctaaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattg

SEQ ID NO: 3128 - DNA, 557 bp, Homo sapiens
aatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaag

SEQ ID NO: 3129 - DNA, 1261 bp, Homo sapiens
agtaggtatgatttagtcagcccaacagacagttcagcagcccctgagaagagggagccttcactgagtgtggcagtcactgtgccggtgagaaaacagaggcagctccttccttctccccgttctgtgccactctactagacagcgttgacagcatatggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 3130 - DNA, 2250 bp, Homo sapiens
tagcttgggggtcccgggaaggagctgggaggacctaggcggccgttccgcggagcccggccgaggaggtaggggtgggcaggcccagccctcaggccgcgacctggtgggccgcgctgcctttttttcctccggatcccgctcggtccgcatcctgctcctctcatcagagcatgatccaggcttctgacagcttccagttcccaccgcgctctcctccacccacgacctcatccccgccagttccccagcacagcgcgaactctgaagctcggcctctcctcccccttccccgcacagcgcgctccgtccttttttccgtcccaggccctgcttctttctcctcggcttcatttccaacaaccccgatcatccacgagggtcgtcgttcccgtgcctgtcccacctccgcaccagaaaaccaaagcatatcccccagaccccgccgcatgcaggccgcgcacacatcaggcgcgccgaagccgccgggcgaggaagccgagggcgcgttttgctcccgtgtggtgatgggcaaagccgagggagcccgggagcagcgggcgtggggcggcgccaatgcgagtgcgagtggtgtccgccgcccgggagcgcccgggcccgagcggattaaccgccgcctcaggtgtcgtctcctgcccgcgaaacaccacccaccgttagtgtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtccca

SEQ ID NO: 3131 - DNA, 1776 bp, Homo sapiens
tagcttgggggtcccgggaaggagctgggaggacctaggcggccgttccgcggagcccggccgaggaggtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatc

SEQ ID NO: 3132 - DNA, 2228 bp, Homo sapiens
ggccagagaggagccaggagccatgagggtggcattaggcatgctctggctcttggcccttgcgtggcccccccaggcccggggcttctgcccctctcaatgcagctgcagcctccatatcatgggtgatggcagcaaggccaggacagtagtgtgcaacgaccccgacatgaccctgcccccggcgtccatccccccggacacctccagactgcgcctggagcggacggccatacgcagggttcctggcgaggccttcaggcccctgggccgcctggagcagctgtggctgccttacaacgccctcagcgagctcaacgccctcatgctgcggggcctgcgacgcctgcgggagctgcggctgcccgggaaccgcctggccgccttcccctgggcggcgctcagggacgcccccaagctgcggctgctggacctgcaggccaaccgcctctcggctgtgcccgctgaggccgcgcgcttcctggagaacctcaccttcctcgacctctccagcaaccagctgatgaggctcccgcaggagctcatcgtctcctgggctcacctggagaccggtatctttcctcccggccaccaccccaggcgggtcctagggctacaggacaacccctgggcatgtgactgccgactctatgacctggttcatcttttggatggctgggccccaaacttggccttcattgagactgaactgagatgtgccagcccacgtagcctggccggagtggccttcagccagcttgaactgaggaagtgccagggcccagagctccatccaggagtggccagcatcaggtcccttttgggtggcacagcactgctacgctgtggagctactggagtccctgggcccgagatgagctggaggagggccaatggcaggccccttaatggtacagtgcaccaggaagtctccagtgacggcacgagctggactctgctgggcctgcctgcagtgtcccaccttgactccggagactacatctgccaagccaagaacttcctgggagcctctgaaactgttatctccttgattgtcactgagccaccgacttccacagaacacagtgggagcccaggagcactatgggcaaggacaggtggcggaggggaagctgctgcttacaacaacaagctggtggccaggcatgtcccccagattcccaaacccgctgtcctggccactggaccctctgtgcccagcacaaaggaggagctgacccttgagcacttccagatggatgccctgggagagctctctgatgggcgggcaggaccctcagaggcacgaatggtgaggtctgtgaaggtggtgggggacacttaccacagcgtgtccttggtgtggaaggcaccccaggctaagaacacaactgccttcagtgtcctctacgcggtctttgggcagcacagcatgcggcgggtgattgtgcagcctgggaagaccagagtgaccatcactgggctgttgcccaagaccaagtatgtggcgtgtgtctgtgtgcagggcctggtgccccggaaggagcagtgtgttattttctccaccaatgaagtggtggatgctgagaacactcagcagcttatcaatgtggtggtgatcagtgtggccatcgtcattgccctgcctctcacgctgcttgtctgctgcagtgctcttcagaagcgctgccgaaagtgcttcaacaaggactccactgaggccacagttacctacgtcaacctagagagactgggctacagcgaggacggcttggaggagctgtcccggcacagtgtcagcgaggctgacaggcttctctcagctcgttccagtgtggactttcaggcctttggagtcaaagggggcaggagaatcaatgagtacttctgctgagggatatgcctccgcaactcacacacctgcctgcccacgctccttctttagctctgacacctgagtacacgatcacccactcttacctgctcgggtacctgcttactcagatacttacacacaacaacagcagcagcagctgctactgcaacaaccgctaacacttgttaagcacttactacagactagaaagtgttctaagtgctaaattcttgtaacaatcatttgcagcaggcatcactattctctccatttccctggggtggggggttaagaaacttgcctgtatcagtcagcttttgctgtataacaaatgaaagcaaaatcttggtga

SEQ ID NO: 3133 - DNA, 3781 bp, Homo sapiens
cttagaccttggttagatttgaaccaaggccctcctcggcctcccaaagtgctgggattacaggcgtgagccactgcccagctgaaaattgatacatttttcaaatgagaagtatttttttcaaatgggtgttggaaagtgagtttcctcacattgttcatgttgtgacactaggttggtgctatgtaatgacatggatatgaacgagctgcctacgaacctccccgtggacactgtgaagcttcgcatagagaagactgtcatccgcagaatctctgcggaggccttctattacctggtggagctccagtatctctgggtgacttacaattccgtggccagcattgaccccagcagcttttacaacctgaagcaactgcatgagttgcgcttggatgggaattctctggctgctttcccttgggcatctctgctggacatgccccttctgaggaccctggacttgcacaataacaaaataaccagtgtgccaaatgaggcgctcaggtatctgaagaaccttgcctacttggatttatcaagcaacagactcaccacattgccaccagatttcctggagagctggactcatttagtttcaacaccttctggagtcctggacctttccccaagcaggattattcttggctgatagaacgttacggctgtaaaaagctctagcatttatctagtcaactctcccattttgccgatgagaaaacaggctcagcaaggttgcatcacccaggtcacagaattaactaatggttgagcctcatcaggaacccaggcacagtaaagttggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcatta

SEQ ID NO: 3134 - DNA, 3624 bp, Homo sapiens
cttagaccttggttagatttgaaccaaggccctcctcggcctcccaaagtgctgggattacaggcgtgagccactgcccagctgaaaattgatacatttttcaaatgagaagtatttttttcaaatgggtgttggaaagtgagtttcctcacattgttcatgttgtgacactaggttggtgctatgtaatgacatggatatgaacgagctgcctacgaacctccccgtggacactgtgaagcttcgcatagagaagactgtcatccgcagaatctctgcggaggccttctattacctggtggagctccagtatctctgggtgacttacaattccgtggccagcattgaccccagcagcttttacaacctgaagcaactgcatgagttgcgcttggatgggaattctctggctgctttcccttgggcatctctgctggacatgccccttctgaggaccctggacttgcacaataacaaaataaccagtgtgccaaatgaggcgctcaggtatctgaagaaccttgcctacttggatttatcaagcaacagactcaccacattgccaccagatttcctggagagctggactcatttagtttcaacaccttctggagtcctggacctttccccaagcaggattattcttggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcatta

SEQ ID NO: 3135 - DNA, 3016 bp, Homo sapiens
atggttgagcctcatcaggaacccaggcacagtaaagttggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcatt

SEQ ID NO: 3136 - DNA, 4070 bp, Homo sapiens
ggcgaaaaagtttcttttgcagacaagaaggggcttcggcgagccgacgctgctcaagctgcaactctgttgcagttggcagttcttttcggtttccctcctgctgtttgggggcatgaaagggcttcgccgccgggagtaaaagaaggaattgaccgggcagcgcgagggaggagcgcgcacgcgaccgcgagggcgggcgtgcaccctcggctggaagtttgtgccgggccccgagcgcgcgccggctgggagcttcgggtagagacctaggccgctggaccgcgatgagcgcgccgagcctccgtgcgcgcgccgcggggttggggctgctgctgtgcgcggtgctggggcgcgctggccggtcagacagcggcggtcgcggggaactcgggcagccctctggggtagccgccgagcgcccatgccccactacctgccgctgcctcggggacctgctggactgcagtcgtaagcggctagcgcgtcttcccgagccactcccgtcctgggtcgctcggctggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgatgccaa

SEQ ID NO: 3137 - DNA, 3667 bp, Homo sapiens
gtaactgaagtcaggcttttcatttgggaagccccctcaacagaattcggtcattctccaagttatggtggacgtacttctgttgttctccctctgcttgctttttcacattagcagaccggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgatgccaa

SEQ ID NO: 3138 - DNA, 1423 bp, Homo sapiens
ttgaaagcaacaactgttttctgcattgaagaaaagcaagggcagggttcagaaagactgaatgtaaagctgggctctgagtctgccatgcccttcgtgtgttgctctgcacattaattaaagggtctacgaggtcagcaaggacgcccaaggagactcagtcatgaaaggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 3139 - DNA, 1318 bp, Homo sapiens
aagcctctgaaatgcaccatgtcggtgcccaggctcattctgctctgccttaagtgtccttcgttctctggaccacagccttcccaagaatgaggacctgttcttgctccctgctggacccctgcctccagcaagatgctgagtacacagacgacccataggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaa

SEQ ID NO: 3140 - DNA, 3688 bp, Homo sapiens
ccctttcttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgt

SEQ ID NO: 3141 - DNA, 408 bp, Homo sapiens
atgcggatggtccccatggagatgttcaactactgctcccagctggaggacgagaatagctcagctgggctggatattcctgggccaccctgcaccaaggccagtccagagcctgctaagcccaagcccggggctcagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtag

SEQ ID NO: 3142 - DNA, 3236 bp, Homo sapiens
tccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggcagctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcag

SEQ ID NO: 3143 - DNA, 3986 bp, Homo sapiens
ggaggcgcaggatggaagatggaggtggtggtgaaaccgctttcctcctccctgtggtcggcagcgattcatccacaggcgcctttttccactgaaatgtgagcgtggccagggtgagcgctgccctcgcggccggccgtggtgcctctggtgtgcgcctgtgtgtgctgctgccgctgtcatcacagatgcaccccagctgtcactccccgctccactctggctcgctgctcgcgcacacgcgtgcgctctcctccctcgcccctttcttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggtgagctgtggcggggctagaggaaccgggacccaggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgt

SEQ ID NO: 3144 - DNA, 1944 bp, Homo sapiens
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgcactgccaagccctgtggtgacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctcattgtcgactctccttgactgccccttccttcgtttttcttccctatgatgtaaggcttcacccctatggtgggtttgggtccgcccctctgtgacctcatgctctgctccactttcaggtaatacacctttctttatttctaactactgcattttctaatgtgtattactgggactatctcttcagctcataacatggaatttgcttttgataattaaatccatgggcaaaaatca

SEQ ID NO: 3145 - DNA, 1235 bp, Homo sapiens
tagttcaagacaacagagacaaagctaagatgaggaagttctgtacagtttaggaaatagaggctttcaaagataattcgcagtgatgtgaaactggcctcccaagccctgataacaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaa

SEQ ID NO: 3146 - DNA, 1876 bp, Homo sapiens
acaaagactgtgtcactactttgtggaatgttattttagaacttccagaatgcctcagtaaatcctgactgccatgtaactgtgtactgtgctgctgagctcttaacatgaagcagcagtagtgaccctggcgggccaggctgacgtgcgtgggaacagtgggagtgaccctggctgggaagcagggaggcctggatattgtttctcctggctctgtgtcctgccattctcgtccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 3147 - DNA, 4392 bp, Homo sapiens
actcttgaattaagagaaggggagctggaggtggctcaggtagagtgcgtaggtttgcagaactgggcctgtgtgtgtaaagtgactaaggcaaaggagtggaagtttgagagaagtttaagagaagaaatggacatgattgcctaaatcagccaaacacaggcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttagttttataacctgctctccttgtgaattcttccttcaaatgattacttaacgcagtagtaatagctagctgtaggatgtcctttaaatttttgtgcaaaaaaaaatttataccaggtatttggaaatatactttacaatattggaaaatgaagtatttttaatgtattacagcaattatgtttctaagcttaatgttaagcatgtagtcttagaataggacatgaaattaaattgtatgtagcttggaatatattgcttcagaaaactgaatgtgtatgtcggtcatattgcctttataaccatgctaatatctatgctttatacatactcaaacttgccttgccttaaaaacatacatactacatacttaaatcaggaattctagccatctcacagaataccaactaaaactaagtgcattgagatctgagattggtaaacccagattcatttaccacagctgtaattaagtttttagaaactattctctttttggggaaatccattgaagttaatttctgttatcttattagaagaaaatgatgttgatatgtgtttcagattttccatttgaaatcttataattaatttgatttatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttgcttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgtcagctaatatgtgaccagcaatgacaaccttgggagtatttattaaatattatgctatgaatataggcaacacagaacagggtttgcagtatagcgtcttgatgctaaattctcatatacctctacacgagaaatatggaggagaaaaacaagcatttacatatattcttcgtcactttgaagatgcatggcctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacccgggaggcagagcttgcagtgagccaagatcacgccactgcactccagcctgggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaaaaaagtgtaagtggattaaaagagaaacttggtctagttcataatatttttaatagggctttccctggctgctggaaaacttaggccagtaagcatctctttgtttaaagtcctacaagacaatttgaaataattcattgttcatgccaaaattctaagtactgtttttcttagcaagtgtaacataatcaggaacaatgggtacaagtaaaacattctttggatgatattcaaagccttattagcactgcacctgaataataggtcattttgcctcactcatttgccaaagtagccatttctaagttaaggaagtttttagataggctcatagccttgtatttcgttttagattgtaagctcaatggcagggatactatattggtaattatgttttcatatagcaaccaccacagtatattcttggtgcttaataaatgtttataattgttaacaataa

SEQ ID NO: 3148 - DNA, 439 bp, Homo sapiens
tcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgaggaacgaacatgatggttaagctaccttcattaagcagcatgaccgcttcctgagctcctgctgccgcatttaggc

SEQ ID NO: 3149 - DNA, 1627 bp, Homo sapiens
cctcggcaagggacgctgctttcccctggcagccacactgctgagcataaatgctttaaagtgtcagcaattgatgtgtggagagaagtatgactgcattacagcttaaagagctttcacattcaggtctctacaggagaagacgagatcgccccgatagtttgagagtaaatgggttaccagaggaagagctaagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 3150 - DNA, 1526 bp, Homo sapiens
gaggacacagtgagagggtgccatctatgagcatggagagcttagcttggacagccagctgatgagggacacatcgaatcaagatacatgacatgcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaa

SEQ ID NO: 3151 - DNA, 1459 bp, Homo sapiens
attctcgtccctgtgctcagagctctcaagcacccacgatggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggtt

SEQ ID NO: 3152 - DNA, 1767 bp, Homo sapiens
ttcccccccctcccgcgcccccgcgcggccggcccctggccttcctccccttcctgctccgggcccgccagtagccggccgcggcggcgagggactaggacgcggctggagcggcgccgggagacgaggggctgagagacggcggcggccgaaagcggagagatgctgggcgtggcggccgggatgacccacagcaacatggccaacgccctggccagcgccacttgcgagcgctgcaagggcggctttgcgcccgctgagaagatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgaattcatcattggccgagttatcaaagccatgaataacagctggcatccggagtgcttccgctgtgacctctgccaggaagttctggcagatatcgggtttgtcaagaatgctgggagacacctgtgtcgcccctgtcataatcgtgagaaagccagaggccttgggaaatacatctgccagaaatgccatgctatcatcgatgagcagcctctgatattcaagaacgacccctaccatccagaccatttcaactgcgccaactgcgggaaggagctgactgccgatgcacgggagctgaaaggggagctatactgcctcccatgccatgataaaatgggggtccccatctgtggtgcttgccgacggcccatcgaagggcgcgtggtgaacgctatgggcaagcagtggcatgtggagcattttgtttgtgccaagtgtgagaaaccctttcttggacatcgccattatgagaggaaaggcctggcatattgtgaaactcactataaccagctatttggtgatgtttgcttccactgcaatcgtgttatagaaggtgatgtggtctctgctcttaataaggcctggtgcgtgaactgctttgcctgttctacctgcaacactaaattaacactcaagaataagtttgtggagtttgacatgaagccagtctgtaagaagtgctatgagaaatttccattggagctgaagaaaagacttaagaaactagctgagaccttaggaaggaaataagttcctttattttttcttttctatgcaagataagagattaccaacattacttgtcttgatctacccatatttaaagctatatctcaaagcagttgagagaagaggacctatatgaatggttttatgtcatttttttaattaaaaaagaaaaattcatataatcgtgtttaaaacacaaatgaagtcagtatttgcctttgttaacccttatccatttgttgacatgtagactgtttacaaaaaaaaaacacatggttaaatgttaaattttaattaaggcccccaaaaattaaatataactttttaaaatgaaaggagtcaccttttacatgactcaggtgaaaaaacagtataaacattaatttactttgtgttcaaaagaaaattccaactgctgttggggaaggacacagaaaagaaaaataaccacccaagaaaaacaaaaacaagaaaaacaaatcttatacaatcttagtatatttatcaaactagtagctagaaagtgaatatgcacattactaagacaaaaaacaagtgtaattcagaactacttgattttttttagttaaatgcaataattattatgcttag

SEQ ID NO: 3153 - DNA, 2111 bp, Homo sapiens
gcgtaacgtgagctcgcgaccagcgcgggggaggcgcccacacgcccgtcccgtcttggtgtctggccccaggcggccgcgcctcccctccgaggtggtcccatagcccctgcaccaggcggcccgcgcccgcgacctcaaggcggctgccccgcgccatggcggcccggctgggtgcgctggccgcgtcggggctgtaccggcggcgccagcaccggcagagcccgccgccagccacgggcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 3154 - DNA, 1617 bp, Homo sapiens
cacagtgctgtgcaggatggagtccagacacccagcagtagcagaaatcgcctgtacgtgttgggcccttcttcatctggcaaaccccgaaggaagggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcac

SEQ ID NO: 3155 - DNA, 2049 bp, Homo sapiens
gccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaacc

SEQ ID NO: 3156 - DNA, 867 bp, Homo sapiens
gcattctgaacttcagcacaaggcaaacgcagaaccagggcttggaatttcgccgctatgcagctgcacccctgccacccaggagatctgaggctcctcagagctgggaggaccgggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacc

SEQ ID NO: 3157 - DNA, 1678 bp, Homo sapiens
gtgacagggcagtctgctttcccataccctgggctgagcccctttgaagcccccagctgctcagtgaagttgcaggggtctggcctctcttctcctggaggtggccaggctgtgtgggagtgggggctctgcccctaatgcccccgcctcccgcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 3158 - DNA, 2500 bp, Homo sapiens
aagtgcatgactcaggactgggtgggagggggctgtccctgaggccctggtctcccccagccaagtcctggcagggggatgctgttcttcaggatcccatgacctggggctcttggggagccccagcccggagagtgacctgtggctttgctggggaaaggggcttggagggtacagggcagtgtccaggattgcagtctcaaatccgaggcccacaggggagctgcctctgtgatcgccattaaggctgtggcctggggtctcagggcagcccaggaaccaaaaatagcctgtaacttgtcactttgtaagtcctgccctccagacacacttccctttcttctccccaagcctctcttcccagttagctcccctgacttggagtcacctctaagccttggcccaggcccctctgcagtgagatggagggactcatcccccggagagtggcatctgcaggcccactggctgcctgtggtcaccccctagggttctagcggggctgcctcccattttcctcagagcatccctgccagctggctggttctcactctcctgttttctaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 3159 - DNA, 1620 bp, Homo sapiens
cagtgctgtgcaggatggagtccagacacccagcagtagcagaaatcgcctgtacgtgtttgggcccttcttcatctggcaaaccccgaaggaagggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaa

SEQ ID NO: 3160 - DNA, 2315 bp, Homo sapiens
ctatactcccgcaacctcccaccgtcacctccccaacacccccaccaccctcagccttgacctccccatcccaccccgccccgcgggccccaccctgccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagatgaggtcaccagaggccacagaggctgagccactcaggaggccagtcacaggtccaccagtgtccggccagtgtttgtccctgcagccctttctggaacctagctgggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 3161 - DNA, 2335 bp, Homo sapiens
ttttgcagtctgtccgtggatactgtgaacatcaggctactcggccgggctcctgcgctcagggcttcgagaaatgctcattttggggctgcccctctgccggcctctctggattcagagggcagccgctgctccttttgttttgtgggcctggctctgggcccggagcagcacctccctggggaggccgcctttccttccgcggcttcttccgtctcctcctgaccccaaggtgcctccggcctctgcctccagctaaggacctctggccaagcctcctgcccagggagaggtgaagctgccgtgcctgggtgccccgtggtggccggacactcctggcggctgctcagtcttgcacgtggctgtgccaagcgggccaggcagctgctatttccctcagagaagttgctggcggcgctcagggaaggaagcacccgaggaggcggagcggcatctcagccacagagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 3162 - DNA, 1695 bp, Homo sapiens
aagatgcctgaagttctaacaccagagatggtttcctgctgcttccaggaacagggtctgttcttagtccaatgtggagttcctcatggggaccccattccccaggaatccaggttccacagtactctgacttggtctggctggtctcggctggcactttccctaggactgctaaaaccacggtgagggcggagagctgagggccgaagaaggcggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgttt

SEQ ID NO: 3163 - DNA, 2045 bp, Homo sapiens
gccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacac

SEQ ID NO: 3164 - DNA, 596 bp, Homo sapiens
gcgctcggctggcggctgcagcagcagagggagacccgcggcaaccccggcaacccagggctcggcgtcgctgccaccatgacgggaaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcc

SEQ ID NO: 3165 - DNA, 1661 bp, Homo sapiens
ggagttcctcatggggaccccattccccaggaatccaggttccacagtactctgacttggtctggctggtctcggctggcactttccctaggactgctaaaaccacggtgagggcggagagctgagggccgaagaaggcgggggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcac

SEQ ID NO: 3166 - DNA, 1704 bp, Homo sapiens
gactgcgtggactcggcggtcccgggtgcctcgggagggagtcagtgcccagatccgcggtgggaactccgggctaggaaagcccgggagggaggtggtctcagcatcgcccccacgcctaccatctcctgcacgcgtttgcggttggggcggcccagggactgcagagggggcgccgggcggggcgtcccggcggggctgtgggggtgggggtgcttgttcgcgtttattataactttactccctttaaaaggaaagctatgcccgggctggcgggcgggcgctcggctggcggctgcagcagcagagggagacccgcggcaaccccggcaacccagggctcggcgtcgctgccaccatgacgggaaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgt

SEQ ID NO: 3167 - DNA, 2115 bp, Homo sapiens
gccacccccgcccacccctctcgcgggcggagcggctcttggccttttttgggcgtctccctgctccgcggcccgggctggcgggcgggcgctcggctggcggctgcagcagcagagggagacccgcggcaaccccggcaacccagggctcggcgtcgctgccaccatgacgggaaggaaaagaaagtggggagagacaggaacagggtccggagcagccccagcagcagcattgaggtggagcaatatgtcggacgccttggccaacgccgtgtgccagcgctgccaggcccgcttctcccccgccgagcgcattgtcaacagcaatggggagctgtaccatgagcactgcttcgtgtgtgcccagtgcttccggcccttccccgaggggctcttctatgagtttgaaggccggaagtactgcgaacacgacttccaaatgctgtttgctccgtgctgtggatcctgcggtgagttcatcattggccgcgtcatcaaggccatgaacaacaactggcacccgggctgcttccgctgcgagctgtgtgatgtggagctggctgacctgggctttgtgaagaatgccggcaggcatctctgccggccttgccacaaccgtgagaaggccaagggcctgggcaagtacatctgccagcggtgccacctggtcatcgacgagcagcccctcatgttcaggagcgacgcctaccaccctgaccacttcaactgcacccactgtgggaaggagctgacagccgaggcccgcgagctgaagggtgagctctactgcctgccctgccatgacaagatgggcgtccccatctgcggggcctgccgccggcccatcgagggccgagtggtcaacgcgctgggcaagcagtggcacgtggagcactttgtctgtgccaagtgtgagaagccattcctggggcaccggcactatgagaagaagggcctggcctactgcgagactcactacaaccagctcttcggggacgtctgctacaactgcagccatgtgattgaaggcgatgtggtgtcggccctcaacaaggcctggtgtgtgagctgcttctcctgctccacctgcaacagcaagctcaccctgaagaacaagtttgtggagttcgacatgaagcccgtgtgtaagaggtgctacgagaagttcccgctggagctgaagaagcggctgaagaagctgtcggagctgacctcccgcaaggcccagcccaaggccacagacctcaactctgcctgaaggccctcttgcgcagctgcctctcggcccctccgccttctcccctcctgctgtccatgcttggccccctcgtccccatccacctgtgccctccgcatcttaccctccctttctctttcctcattgccttctcccttcctgttccctcatctctgccttccccatgtctctcctctccttggccgtggcttctgtctgtgaggaggcaggagctggggagtgggagcctatgaccccacgtctgacagccatgtccacctgtgcccacagcttccgcccacagacctccagggacaggagcaaattgcaccacagctccccgcctggcctggccctccccaggcggctcagtggctcatgctgtcctgtgagagcccctgccccagagcggccccactaagcgcatgtggctcctgggctacccacagccagggcagcctgctggagccacagggccagggccatgcagatggaggcctctgggagccacctccaatccctcaccactcactcaaccagtggcacagtgtccttgtgcccacactgagccagcaagtcctgctgtccacacccacaagctacctggagggacaggacccacctccatccttcggaaggccttcctggaatcccaccttggcctccgccctcggttccgccccgcccctctccccccgaccttggggcttgtgtcgagcccttgggtggggccaggaggaggtgatggcgtcagaggaggtgtggtcagaggtgacttgttcccacctccagggaggacgcttcgtcttcggccagcgcagacctggtgtttgtttgttgggctcacgcttgcacaatgaaggcttgttcacacaacc

SEQ ID NO: 3168 - DNA, 6112 bp, Homo sapiens
cggatacctgctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttttaaataaatcaccagggccaagattgagtgaatcttgggtccatagcttttccagatattagcaaacccctcattaggctataattcaaactgcatcagttcaaagtgaaacctacacattgctccttaccctcacctgctccacaatccatagtgctgagttgtctgaattggaattccagttaattgcaagttcaacctgttttcctcttgaaaatcgcaaggtatcatactatatttatattttcttcaggttctagaagcaatcggctttttcttttgtttccatgaattttattatgcattaatagaatggaccaattttagctcaacttttagtttgttagaagcaagtgtaggaactctagcactgtagtttttaattattgcttgtatctattattattaattccaacagagtataatgtatatttattctataaaatatatattatcagagtgcatttgttacaacttaggttcttttcttaccaagtattaagaatctagtaagagaatactagcaaaggacctagccctgtgaacagattctcgtatgttatatacataaacccactctcaatattttttgagttttatactttttgattgataaacactgaagaaatctaaactctactcacactgatgtgctgtcatagaagcctatttcatattttaaagcttagcaaaactaaattatatgtgcatatatattcaaatatttgtgtcacacaaagtttaggtcaatttccccaaatataaaccagatatttttggcactctcagataaacaagtattatttctcttataattgggcaggtggaaaccagtgatatcaatattgtgaatggcagatgctgcttcctctagaaaaataaaataaaatcaccaactttaatatattcccataggtaaatagacaatgagatatcatttttcagaaaatatcattcactggaaaataatctgttataactacatttacaggtcataatttttggtttatggtaaatctaggcacctaagtctgattttactttatgaaataaataggaagcaataattgtttgggcatttgaataccttaagcacataaatgaacctaagaaaagaataattgcttagttgaagtattcaaaatagatcagtaaaccacaggcaaatatttgaatgttcccttttctcaaatacagaaattgattccccaagatacaatacaatttgacacttcagataatcccccaaaatagaaatgtatgaagctcagtttagactgtcttcttgaaaataaaacaaaaccaatcaaaactacccagcacattttattatgccctgttgggtgatagtattgtcaataccaggttttccctgctcttcacaatgcatccctcaccagaggaaaaacagcaagaaaactaggacatttgctaatttcaacaatacacccctgtgataacagattcccatccttgaatacatatcattttttactagagagaacgggggtggtgaggtgggggcagttaggaccctgtatgttatgtaaaatagatttacaaaaaggacaagcatgataaaagggaatgaatggagacgatgtattattcagtttgaaagagatagttcacatttttataagaaaaatttaataaaacatatattttagttatcatttaacaaagatatattaaagctattcaggcaatgccacaggattctcatgaagggaaatcactgaacccttgtcatgagaaaatggtcatttcaacacatttcaatacattgtataaatttggagcttaaggtgagtgagtatgttttcacttagtcataaatgtttggtcaaaattaaagttatcatatggtttcacatcaatacaaatattgtcacagtgttacagaaacaactatcaaatggtaagatagtttacatttgtgttttctagaaacctttgtatttatgcttcatttggttaatgttaagtgctgataaaggcataccagattgtttgtcaaagtaaagaagcaatccatcacacctaggacatctaaggatggattatacgtcagagtggtctcatatacaaatgaccattttccttcagtaaaatcttgttggttgaaatgtaagtcttttcctaaagttttaatcagaggtagccatcactaagacttaagccacctgtggttctcttaagtttcactgaagccagaagaaggaaattaccacaacttgtattatactaattatcttcattattaacgatcatattagagccactgacatgtcccaaattatattaaaataaaaacctgcattgctctgacatgaagctcaattcaatgtaataaacaaattaggtattaaacgttataatttaaaaaacttctacgatatcaccagaaatcctggtgaaatttaattttttcccttttttaggtcagtggccggtgggatagatttttctaaactttttcctgctatgattttgaaggcaaatacatagagcacagttcagtaaaagagtttccaagccttttcactggagcatttacattttgattctgttgtcatttgaaatagaacatctgcagggagataatgagcttaagttacaattgactttggaaagaataacagacttttgtgtttcctcaatcatgtagtcaatagggaattctccagttatgtgaacaatcacagtcttttaagacaatacttagatctaaatgcaaaatctagcatgcagaggctttttaaggattttagactgtctccaaagaacttggctcgagatggattacacagatttacaaatgcagttttcaactgtgacatcaaactgatcttatctcatttcatgttactcaactgtgcccgtaggaccccaagaggtggaatattttgtctacattattttaaacatctatagatatgtgtggatgtgtgaataatgcctaaatttctcatcttttaactagtttgtttttatcatacagacacagcctgttcataagaccagctttagacaacttagaactcaatgctctgaagattcagggaggccaacatagaaaaagatcttccaaaatatggggtggtccaacccatctcatccctctctagctggaaaactatagagaaagggctgtgactgccttgaccactgcctggcacaatgtaggcactcggtatttgttggatgaataagtggctgaatcagtgaatagacaaaaaacatggattttgccttctgaaaatctcacaaattttaccagcttatattatactgattgtcactatgatttctaagtttcatggttagaaccatattttgagtctatataaaaactttttagatgtatgaatttgaaatttcattaattactttaaaggcttcaaagatttgaggacatttgaacagtggataaggaacaatgtttggggatacagagtttttatgctgagttgaactcaacctttctagttctttatacaagcttcctgaattatctggcaggaatgattcaaacataaaaccccatttttaaattttataaaagatattttcatttttatataaaaagatcatcaggcatattatcccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaacaagacagacacaatccctcttggaggttactgtgagaaactctccaacatttactctagcaataactagagagtttactgtccattgggtcctcttcacacctgatagaaaaaataaaattcctcaccccatggaagtcatgaaatactccctgcacagatttgtgtgagcttgcttttctaaaaccactgctcaaaaatgctgcttagtttatctataaaccacggttataccccagtgaggtaggtaagtaatttattcataactaacatttatgcagctctattttctagccactgtgctgagtgcttttatggactatctcaccaaatcccttcaacaactctattcagtaggttccattttatagatacaaaaactgaagcacagatatattatgtgacttgtccaaggtcacacagctagcaggtggaactgggatttgaacccatgcaatctgacacaagagttcatgtgtctaatcattatctgtggtttgggggacaccattacattaaaatgaatgagtcactaagtgagtcactgtatataaaatacttggaaattgtaaagtaatatacaaaagatattaacaaagtattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaa

SEQ ID NO: 3169 - DNA, 2658 bp, Homo sapiens
gtagcggacatggcgggctcccggctcccgcggcagctcttcctccagggcgtggcggccgtcttcatgtttgctttcgcttccctctacacgcaaatcccaggctgggggatctgcaggccctgactcagaggtagtctagtctgcaagggctgtccagggcctggccatgacatgccctcccacaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgctggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaagccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttg

SEQ ID NO: 3170 - DNA, 2260 bp, Homo sapiens
gggccctgctctagcgggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgctggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcgggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaagccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggctg

SEQ ID NO: 3171 - DNA, 2582 bp, Homo sapiens
gggccgcgtagcggacatggcgggctcccggctcccgcggcagctcttcctccagggcgtggcggccgtcttcatgtttgctttcgcttccctctacacgcaaatcccaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccaccctgtcatctacttgctgctttgggccgcctacctgtcagcctgccaggtgggccaggtgttcctttatttccagtgggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactgccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgctgctgcaggtcctgattatcatcaccggcaactacaacttcttcaacctgatgacgctggtgcttaccactgcgctgctggacgaccagcacctggctgctgagcctggccacggcagccgcaagaagacggccacctcctggcccaaggccctgctggccaccctgtcgctgctgctggaactagccgtctacgggcttctggcctatggcactgtgcactactttggcctggaggttgactggcagcagcgcaccatccactccagaaccactttcaccttccaccagttttctcagtggctgaagacactgacgctgcccactgtgtggctgggtgtggcctccctggtctgggagctgctgagtgccctgtggaggtggacccaggtgcggggctggctacggaagctcagtgctgtagtccaactgtcccttgtgggcactgcgaccgtggccttgttcctgattagcctggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccagtgatccgccttgtccagagccaagtggccaggtatcccttccacaagcagccgcccacctacgtccgagcccagcgctacaagtactggttctcccagcctggggagcagggccagtggtggcggcgccagtgggtggaggagttcttcccatccgtgtccctgggggaccccacgctggagacgctgctcaggcagtttggactacaggagaaaagcccacctcgcacccgcagcgccaacagcaccctggcccaggccctccactggactcgctctcagctgtctcccctggaggcccccgccctgctctgggggctcctcatggccgtgggggctgtcagatttgtgcaagccctgctagcaccctgttctctccggtcctccccgctggcaccagtcagcggggagaagcgcaggccagcctcccagaaagactccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtctgagtctagagcccccaaccctaggccccgtgccagaggggaagaggctgactcccaggggaagaggggaagcactgtcatcttccacgtcatcttcacaccagcccatcctgccctttagatctgggcaccaataaaggcgtcttttgtgcttggc

SEQ ID NO: 3172 - DNA, 2321 bp, Homo sapiens
aattctctaggttgcaaattgggaggattaggaacaagtaagagagatccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgta

SEQ ID NO: 3173 - DNA, 2495 bp, Homo sapiens
ctccgccccctccgcgccagccttttgctctttcctttcattaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgta

SEQ ID NO: 3174 - DNA, 2321 bp, Homo sapiens
aattctctaggttgcaaattgggaggattaggaacaagtaagagagatccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgt

SEQ ID NO: 3175 - DNA, 472 bp, Homo sapiens
cagaaagtgagccagatggagctggaatgtagaggactcgtcgtgagcggggagcccacttggtcagctcagtgaaggctctccctcagacgccaacatctacatgcggatatggaagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgatt

SEQ ID NO: 3176 - DNA, 2723 bp, Homo sapiens
atgcaaatgagacgcccggaggccccgcccctccctccacctcggagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaac

SEQ ID NO: 3177 - DNA, 2552 bp, Homo sapiens
agtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagttaagtgtggcgcaggaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaac

SEQ ID NO: 3178 - DNA, 2276 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtggcaggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgc

SEQ ID NO: 3179 - DNA, 2357 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcggtgagtccggcccctcactgcccttcccaggccctcttgctgacccgtggggagccctccctgaccccaacccccatgccccagatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgc

SEQ ID NO: 3180 - DNA, 2272 bp, Homo sapiens
aggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcgatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgc

SEQ ID NO: 3181 - DNA, 1892 bp, Homo sapiens
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagcagggtgtcctccaaagcagccccaagaacactgaaggcagcacggtctcctgcactggctccatccgctataaaaccttga

SEQ ID NO: 3182 - DNA, 4505 bp, Homo sapiens
cttaagtatctgtttagaagtttaggaattttctatactgtcttcttgaaatcaacttagagaaaatgaacacaatagattttaagatcttaattcactaatgtttaatgaatatgtttgatgctgacacaaccaccaacttggtaacaatttctttcattttgcctataggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 3183 - DNA, 5369 bp, Homo sapiens
gagctgtcattcctgggtagcaacaagctgtcagttaatgcctacctcagcctacttttcagtatgggatccaagatctcatttcgtggaggtaggggttggttttcttgctatgggtcagcgcgctggagcagggcttctgatccttagcattctttaatagcattcctagagtgacctaggaggctccccaggaggagactaggtggcttagctcctcagcctaactactgcagaaaccaggagtgcgtcctccttttcggattcttgacgtcaagctccgacagccttggagcgtcgcaagggcggtagagagctgagggagggtgacagggaggggaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaa

SEQ ID NO: 3184 - DNA, 4846 bp, Homo sapiens
gaagccattgcagcaacagcttggaggagggagctggacgtcgtctctcgccagaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggcgccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatc

SEQ ID NO: 3185 - DNA, 3288 bp, Homo sapiens
ggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagca

SEQ ID NO: 3186 - DNA, 4134 bp, Homo sapiens
ccagcgccgctgcttctcgaatggtctcgtgcaggggcgcagcggccgctgcccgtcgcccgggactccccgccctccctcgcgaccccgcgccggggcgggcggcgcttgcggcgggcagggggcgggcaggggagagggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagcaggaatgtttttcctgttggaagccttagccatatattcttatgtcaaggttgcttctttgcaccttgctaaacctgatacgaatgcaggagttttaaattcttcaaaaactcagatttaacccagaaccagagtaaagtcacctctactatttacacatcataggctcaagattgtacagtgagtgatgctgtcatgaagaaaattcagatgaaaaaggcaagatacatgtgaataaggcaaaagccagaaaatagcccttattcatgatgctgttactgagaataatgaaaatcatatttcagaaaatattaccatgtaaatatgtacatatgtagtctagtaaaagcaggcaaacacatatctttctgataaaaacatctcctttttattctacttacttggggcccaggtcagtataatttagtcaacttgaaaatttcggtagtctctgtttgcatggcagaaattctgcacatgttttatctgattcctgtgataacttaaaaggctcttttatgttaaaagagaggtgaatcttctttgacagactttgtattttccacttctaactgggcctctcttttctcaggatctatcctagccaaatatctcagttacatttaccatacagtttcctttgtgaaagaacagtaggggaggaaataattctctgctgtgtattgtatttttcaaataaaaatttaaaaattcaattgaaaa

SEQ ID NO: 3187 - DNA, 1444 bp, Homo sapiens
gcaagatggaggccgcgcagaggccgccgcctgggccgaggcagccgctgctgggagcgccgagccgcggcgcctaggccgtgccagtcccggatccgctgcctccggccgtgcccagcagctcccagacgcccccagctctgccccaggccccgccctcgcgggttccttgactcagggccgcttctcgcgtgcgtccccagctcccgcccggcagcccggcgctccgtcccgggccggcggcccccgccagccgccgccgccgccggccccgcctccgggcaccatgctgccctcgcaggaggcctccaagctctaccacgagcactacatgcggaactcgcgggccatcggcgtgctgtgggccatcttcaccatctgcttcgccatcatcaacgtggtggtcttcatccagccctactgggtgggcgacagcgtgagcacccccaagcctggctacttcggcctcttccactactgcgtgggcagcgggctggcgggccgcgagctcacctgccggggctccttcaccgacttcagcaccatcccgtccagcgccttcaaggcggccgccttcttcgtgctgctctccatggtgctgatcctcggctgcatcacctgcttttcgcttttcttcttctgcaacacggctacggtctacaagatctgcgcctggatgcagctcttggcagctctgtgcctcgtcctgggctgcatgatctttcctgatggctgggatgccgagaccatccgggacatgtgtggggccaagacggggaagtactccctgggggactgttcagtgcgctgggcatacatcctggccatcatcggcatcctcaacgccctcatcctctccttcctcgccttcgtgctgggcaaccggcaaacagacctgctgcaggaggagctcaagccggagaacaaagattttgtgggctctacagtaagctccgtgttgcggcccgggggtgatgtctctggatggggagtccttccctgccccgtggctcactcacagggaccctgaaaggccaggatcacagcccagtaattggcctgacctcagcttgtcctgccttctgccctctcgtcactccattcaagctctgagggaagaccctgatctcagacttacttctcaccgactaccctgcaagctccaggctttgaggagaggaaagcctggatgtggcctgggggagaggagaggccctccaaaccttgggagggtctaattcttgctcctccctcaatttgacctaagggagcctgcatctgcgtaggcccttgggcttctcctctcctctctagactggcctggaggtccctgcagatccccagggagagcggagctgtagttccagctccccaggccccctcagtctggagggctgccgcctggctgtatccgcacctcttctggtccctgcctcttcaagaa

SEQ ID NO: 3188 - DNA, 8185 bp, Homo sapiens
acaaccccccgcgggagcgggactggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctgcttcatcgatatggagactttaagaaacagcatagacttgtgattattggaacactgcttgcttggtatctctgctttcttattgtcttcatactgcctctggatgttagtacgacaatatacaaccggtgcaagcatgctgctgcaaattcaagccctcctgagaatagcaacattacaggattgtacgcaactgctaaccctgttccaagccagcatccttgtttcaagccatggagttacattcctgatggaatcatgccaattttctggagggtagtgtattggacgtcacaatttttaacatggattctcttaccttttatgcagtcatatgcaagatcaggagggttttccatcactggaaagatcaaaactgcactaattgagaatgcaatctactatggcacctatttgctgatttttggagcatttttaatttatgtagctgtaaacccacatttacatttagaatggaaccagcttcagacaattgggatagctgctgcaaatacatggggtctgtttcttcttgtgttgttgttggggtatggcttggtggaaattcctcgatcatactggaatggagcaaaaaggggttatctacttatgaaaacgtattttaaggcagccaaactgatgacagagaaagcagatgcagaagagaatttggaagatgccatggaggaggttcgtaaagtgaatgaaagcatcaagtataatcacccattgagaaaatgtgttgatacaatacttaaaaagtgccctacagagtatcaggaaaaaatgggtaggaacatggatgattatgaagattttgatgaaaagcatagtatctatccaagtgaaaaaagtctggtaaaactgcataaacaggtgatttattcagttcagagacaccgtcgaactcaagtacaatggcagattcttttggaacaagcattttatctagaagatgtagcaaaaaatgaaactagtgctactcatcagtttgttcacacctttcaatcgccagagccagaaaatcgatttatccaatatttttataatcctacatttgaatggtactgggaatgtcttttgcgaccatggttttacaagatacttgctgtggttctgtccatcttctctgtgattgttgtgtggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctattatgggttccatgaaagttttatcctttattgcagatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcagaaagctatgttcacatttatcatttaacatattgatttaaatgttgattatgatattcaaggataaatcctaggcattaatgaaaaatagtttttttttaagtagtcaaagagtccaacaaaatccttcagtatttaaaggtacctgcttatactttttgagaaaaaaactggttattcaaaggtaaaaagtgaatccatttactgttattactgatacttaaatcgtggtttatagaaaacaaaactatattagaatggaaatgtgtaataacttgttggttaaacattcttactaaatagactgtttttaacctttgtgtttaagataaatttatgtattatattttaaagcactagtgttttattgaaaagtgaacatgtttgattgcagcatgcttgcagagagttttcttatgtccctagaatatttgcaactcttactgaatccatgctacatttggtgaccatacttcagcttgcctaatacagtctcagtgtaacacctagtatcctgtttattactagtgattactttcaccctcaagtatcccacccagtttgaagatgaattatatggttcccctaacttgaagttaatctttccccaagacataaatttaaaatttttatttttatttttaataaatattatcatgtaagtttttttttaaaacacagctctatgcagatattgaaaggaatagagcatcatcctcattatctgaaaattttgatctttgagtttttatgatctttgcaattagatcccttttaaaataattatcagtggatagacttactctgaattgaaggtcatatagactacacttaagaacacacacatacagtcttttcatgtgaagtgtggccagaaagcaataagccaggagcagagataatttgatcctctttgtaatttaatgattgactaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtttattgctggggaaccaagttaatatttgtcaagccaccctgtgtaaaaaactgtaatgggtagaagttttctcttttgagaagcttattgaaatataatgacatctactgcaaaataggactactaaatacatatactttacatgcaaagtacatttcttaaagaattatttctggtaatttttgatgactttattacttgataataagtattagtttaaaattttccaaattattctttaaatagttgttaggtaagaatattcagtaagccagtaattcagaataactattgtagaaaataataataatctattaatttaatgaatcacctctaaattactaattaacttcttttacaacataaataacttgttatcaatagagcatttttgtaaaaaacaaaagaaagaataagtttaattattaaaatttgctctcttaccaaatgaatacaagggcttttgaataatctcattgcataagaggccctcatttcacagaaatggtaagaactaaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaataagaattttgctgattgtttatatattttacttcatttgagattaaggttcttttaagtagattcaggcgttctttgttccttatcaatttattagcaaatatgacaaatgttttaaaataaatatgtgtactttagttttca

SEQ ID NO: 3189 - DNA, 2441 bp, Homo sapiens
ggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccagatatggtccagacctgtacatgaataactttggttagtcagagtgaaatattcaataatgagtggtgcagctttgggacttgagattgtttttgtcttttttctggcattatttctgcttcatactgcctctggatgttagtacgacaatatacaaccggtgcaagcatgctgctgcaaattcaagccctcctgagaatagcaacattacaggattgtacgcaactgctaaccctgttccaagccagcatccttgtttcaagccatggagttacattcctgatggaatcatgccaattttctggagggtagtgtattggacgtcacaatttttaacatggattctcttaccttttatgcagtcatatgcaagatcaggagggttttccatcactggaaagatcaaaactgcactaattgagaatgcaatctactatggcacctatttgctgatttttggagcatttttaatttatgtagctgtaaacccacatttacatttagaatggaaccagcttcagacaattgggatagctgctgcaaatacatggggtctgtttcttcttgtgttgttgttggggtatggcttggtggaaattcctcgatcatactggaatggagcaaaaaggggttatctacttatgaaaacgtattttaaggcagccaaactgatgacagagaaagcagatgcagaagagaatttggaagatgccatggaggaggttcgtaaagtgaatgaaagcatcaagtataatcacccattgagaaaatgtgttgatacaatacttaaaaagtgccctacagagtatcaggaaaaaatgggtaggaacatggatgattatgaagattttgatgaaaagcatagtatctatccaagtgaaaaaagtctggtaaaactgcataaacaggtgatttattcagttcagagacaccgtcgaactcaagtacaatggcagattcttttggaacaagcattttatctagaagatgtagcaaaaaatgaaactagtgctactcatcagtttgttcacacctttcaatcgccagagccagaaaatcgatttatccaatatttttataatcctacatttgaatggtactgggaatgtcttttgcgaccatggttttacaagatacttgctgtggttctgtccatcttctctgtgattgttgtgtggtcagagtgcacattctttagcactactcctgtcttatccctctttgcggtcttcatacagctggcagaaaaaacatataattatatttatatcgagattgcctgcttcctttccatcttcttcctaagtatctgtgtttattctactgtgttcaggattcgtgtatttaactattattatttggcctcacatcaccagactgatgcttatagccttcttttcagtggcatgctattttgccgtttgacacctcctttatgtcttaatttcttgggtttgacccatatggattcatctatctctcacaagaatactcaaccaactgcttatacatctattatgggttccatgaaagttttatcctttattgcagatggattctatatatattatcctatgttggtggtaattctctgcattgctacttattttagtttgggaacccgttgtttgaatctgctcggtttccagcagtttatgggagatgatgatatgacatcagacttagttaatgaaggaaaagaattaatcagaaaagagaagagaaaaaggcaaaggcaagaagaaggtgaaaatcgaagaagagaatggaaagaacgttatggacacaatagagaagattccactaggaacagaaatattcatactgaccccaaagagtcaaacttctcagatgttaataccaaccgttctgcattcaaatataccagggctaataacaggactgaaagggaccggatagaacttctccaagatgcagaacctttggattttaatgcagaaacattcactgatgatcctcttgaatctgaatcaggaaggtatcagcctggtggacgatatctctcgatgtctcgcagtgacatatttaatgatgtttaaagtctgaaaaagtttgtgggaccactaa

SEQ ID NO: 3190 - DNA, 785 bp, Homo sapiens
cagcaggaaaccgaagacatgaacaaggtcttcccccagggagagaatggctacactgctgctgaatccaaagcccaccctggaggggaagcaggcggcggccacctctgctgctcacgtcgcggggcctgcctctctgcctctctgctgctcctcctggcaactgtggcggccctcatcgccttggtcaccattcttggactcccatcatgcaccccaggagcccaagcttgtataacactgacaaacaggacaggcttcttgtgccatgaccagaggagctgcattccagccagtggggtctgtgatggcgttcgcacctgtacccacggcgaggacgaggatgagagcttgtgccgagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctt

SEQ ID NO: 3191 - DNA, 654 bp, Homo sapiens
agggaacccgtgctgagctctctgcacacagccccagtcgggcagcaggaaaccgaagacatgaacaaggtcttcccccagggagagaatggctacactgctgctgaatccaaagcccaccctggaggggaaggagatgtgccccagagcctcccccacttccttgtggcccactgtggagacccggcctcctggatctactcagaccaaaaatgtgatggcactaacaactgcggggactgttcagatgaactgagcccagtaactgtgtgcccaccctgcggccctgggtggtggcgctgtccttcaaccttcttcaagtactgcgactgtataccgaggcatctctgccgcgaccatgtacagcactgctccgactggtccgatgagtatgcctgtcccggaccctgagtgggccactcaggccagcatggaaggctggctggaatggcactgataacccttcacatgaaaatcaaatcctagcgcacaagggcaggaagcagcctttgaaatgggatctacacatcatttctgaataggaattttctctcctcctttcaagttgttcagcctctgcttgaatgcttccaatgaccaggagctcattaccatgttaggtggcttctaacaaagatgatgtggtggaacccc

SEQ ID NO: 3192 - DNA, 4012 bp, Homo sapiens
ctgaaccaaatgaagaggatctggaaggcaaagcactaagatcatagtgaagacttgcctcccccttctccttgtgtcccaccagcctccctgctggcctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggaccttgtggtgcctacttccgctgccagaatggcaggtgcatcccctcaagcctcgtgtgtgacccctggggcatggacaactgtggcgatggcagtgaccagggctcctggtcaccagctgactgcagaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtgagtcctgccttcccccacctaaggcactagctcttcctgagcaccagcggcatccgtccgtccgttgtctgttggaggagtccctgggccttcacttccagatgggtggggatgtggcctggggtgggcggggcccggtgggcggggccctatcagtgctgggctctgcctgtagcagctcctggtaagagttggggtgggccttcccttacagcccctgagggagggaccccaggctgtgtgctggcaggagggggtgggaatgcaggccaggaggacgtggtaggagggggagtctgccagaggaggtgccaggggctgggtggaggtgggtgggggtgctgaaaaacgagctggtggggatggggaccgcctgcccaggggtgagctgccttttgctccacagccggcactaaagacaattcccaatcctgagtgggtggcagagactcctgcgatgcccgtctcaggtagctgtggggcaccagcccacaagccgaggttggctctcctaggagtgagaactgcccaagggctgcagaaacaggccacccagctctatctgggggctccatcggtgggtagggggacagtgggggcagttctgggcccacccagccactgttcctgaccccaagtcctggtgactttctgaggtgcccactcccatccaacctgccttgctggccagccttgtggctttgcccagctgtgtgtgtgagggtggcatgcccacctccagtccagcccagggcggtagcagcaaagcgtggcatcgcctcggtttcttacaaaaattcataataatattaataataatatactcgacattgtcgggctggggcgtggcccgggagtccgtgtggggcaggcaggtgcctacgaggggcaggggcgtgtgttggccccggcctgggcgcggtgctgcaggtccaggggctgtgggggcggggcgccgggtcgggccgagtgcagcaccaggttcttgacacagcctgtgatgcctgaggagaatctgcccccggtcagcgtggccacgtcaggggctccgcctgccgggaggtgagaggacagggcctgtgggctccagcagcccaggaggcgaggaaggctgggcgagctctagccctaagggagtgccgttcctgcccctgccctgagaaggagccccagacttaccgatgtagacgctgcccttggcgttgactgccacgttgggacctggggaccggccgctgaccagctcctcaccgtcgacttggatggaacctctgcggccctccctgcagtggaactgggtcaggcccctttccacaaacttcctggtcctccccggccccacgacagagtcccctccctctgatatcgagactccagactcagaagtctgtccctgtttcccaagctctttctttcccccgctgaacgagagatcgggccccacaaacacagcttcctcatttctgcacccaggtttcctcccactcctggggcactcgcctgcccccagcggagttcagtccgagatggaagcccgagccctggctggtgggttctcccctcccctggcttcaagttctgtctccacagagctcaatacctgcctctctgcccatggtagggggcgtcctgccccactccagaacgctgggccccatcccgagtgcccggcagggtcccttaccgcagtgctgtcacccggtgccactcgccgtcattgatggggtcctcagagaccaggcgggcctccccactacccagctggtacctgcagtcatccaggcccaagaagtatgagctggggcaggaccggggggtggggtgctgggaccagggaagggagaggaagggccaggtgccaggacctacctgaagacaaggtgcccgtcttgaagcccgaggctgatgaagtccttgccttggccggcctctcccacctcctgccagggaagcacagggtctctggggtccccagcctggagagcagaggctgccgaggccagggggctctgctttcccctccccccaccactccggccaccaggaagccagcttcctgccccaggagccccaagagcccagccggatacccacactcaccacaccctgccagagcaggaggccactggctgtgctggtccgaacctccagctcgatggtctcgggcacctcgggcaggctgcggaggaagagcgggtgaggggacagaagtcccagattcccatcctccccattaggcccatgggcccttccaatgccagtctcacctcctggagaagacatggccagggaaggcgaggaagccatcatcgtggaaataggctccgtactgcccaggggcatctgtgggagagaggagggtggtgccatacctgctgcatcaggcatcaaaatcccccgtcagttcccctgacccccacctccacgccaacatgcaggactagggggctccgagcctgcagtccctggggacccacgggggctgccaacagaattcagggagcctatgaccttggatgggaaagcattacacctcaatttcactcacttctcactgaaattgagcagttctttcaatgagatgtaggcaagaaaccaaagtagcagtggtaggacctgcaactttgttactagtatttgcttatcacatgacagtagctgcaaatatttcaaaatatcatttacacatattgctgctttgaaattgtggtagctactgagatcaccagatcttgttatttgatgtgttaataaagaagcacatatatagcaagtcaggaaactt

SEQ ID NO: 3193 - DNA, 1180 bp, Homo sapiens
ctgaccaggccccatactccagtctccccagagaccccaagctgaagattctgtgggtctgccccattgctgggcacagcagagcctggatggaggcttgttgtcttctgcagttgccccaaaggttgctcttgctgggggcagccgccctgactgcaactgctttggagacagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctctttccgtctgggaccttgtggtgcctacttccgctgccagaatggcaggtgcatcccctcaagcctcgtgtgtgacccctggggcatggacaactgtggcgatggcagtgaccagggctcctggtcaccagctgactgcagaggtccctctccggtgcccagccagacaggaagtacagatgcccatacctccagatccctgactccctccccagctctcgggtctgcaggatccctctggattgcagctgagaggagttccccagcaggcagggaccccacgagacaagacgcagctttggaaggctccactgagtgaagccctcatcaaagactcaggaggcccctggcggggatagcaccgtttattaagaaaaatcaagacaaagaccacaggagggtcccttctaggacacagaggccaggcgtcccaaccccacagtctgggggccactggcaggatggcacttgagctggatcttcaggctcctgcagatggggcagggtggtcatatccccctcctctctctctcagtcgtttcctcccactcctggggcactcgcctgcccccagcggagttcagtccgaga

SEQ ID NO: 3194 - DNA, 3798 bp, Homo sapiens
agcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcacagcaaaccctctgctttgctccaccgcccgctaccactgcaagaacggcctctgtattgacaagagcttcatctgcgatggacagaataactgtcaagacaacagtgatgaggaaagctgtgaaagttctcaagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgttggagagacagcatataaaacagtattgaaataggctgggagagagcaatgtttctgtgctatattggatgctcagaagtgcaggagacgctggacccaattctctctgctgggtagttaccttatagcatttggggatttgggttagatgatctaaccaggaggccatcactggatggtcacccccccaaaaaaattccatttgagcatcaaaacctgctttgcacaatcctatttgatgcccccagttcagcagagtcagtggccaaagaaaactttggacgtgagtaacacccttcagcagtcgcaacgttattttggttttgtgaaggactctgaaaccatctaccctgtataaattctggctttagaaatttgcccaagaatgctcattctgagagctttcctcagcagcatatatcatcagcctcatcctaaaataggcagggagcccctcccatgagtttatccaagttctcagctcctaaaatgcaggctgccaagaccctacacctgccctggctctacagccacttacctggtttctggactgtcaccctcccagctgacctgcccgtagccaaggaatgaggacctaacttgagttggcccaaagtctgacctggctgtatgtccctgtggcccacacccagcctgtcttgctcattcatgcagcctcaacactggcctccaaagttcccttaacacttgcaaagtcctttttacctgtgcatttggacttgaggacactggtttctatcacaggtgagagccatgttcaatacctccagcaagctctcctggctccctgcactgtgcacgctcctcttcccaaggtcccaataccagcacctctagttagagttagggtcagggtcaggcctctcccaacatcccagtagtttctcctctgagacacatgggcaagagacaatttggagtcaagattttccatttggatctattttaaatcttttagaaatgcatttgaaacagtgtgtttgttttttcccttctagttaagggactatttatatgtgtataggaaagctgtctctttttttgtttttcctttaacaaggtccaaagaaagatgcaaaaggagatcacacccttgccccgctgagccccgtgataacaagtcactccagactaacctgtgtgccagacatttgtgcattgttgcactttgaggttattatttatcaagttcttgaaggaagcagaaagagggactcctctctccctccgtgtatagtctctatgtttgtgctagtttttcttttttttctctgtgtccagtcagccacagggcccgcctccctgcaggaataaggggtaaaacgttaggtgttgtttggcaagaaaccacactgactgatgaggggtaaaatggaaccaggtagagccactccgggcagctgtcacccattcagaacttctttccgcagctgaagaaatgttcagtaacctgtttgacgctaattaaaacagagcctgcaggaagtggggctaaagtggcattcagtgatcctgttctgtagacttttctttctttttttaaccaaatccaaaggatgttacagaaaagctagccactggtattttgttttgtttaaaaaaaaaaagaaagaaagaaagaaagaaaaacggaaaggaacctagctgcctgtatctttcatttttaaaatagcacttgagttattttctgagtaatccaataaagaacttttgatgacagccagaatgtgttagaactctggctgaacatttcatctcctgtgagtcagaagggctttatttctccctttgatggggccccttcttctttctggtgctctggaagttgtttagaggaaagaattctaattttaattaattgcgcagtgagttaatctcactcgcttttctgcttccaggcatcttaggaaaaacaaatggttttagtagataagggatgcctactaatgcttttttaaaacaaacagggacatttttattatagatttgatttttttaatgaatgtttttaaaaatatataaataggacaccaaagcggcagggtttttttgggggggagggggtttgttttccaactcaagatggcacattagtggccagcaatattttttaactcattccaaccaggaagcttttttatacattgcctaaatctacgccaaccagaaaatagtctcatctctttttttctcaaatgagatccgtgttttattttagcattaaattagttacactgtgatgactggcctattacctgactcagctccctctaccttgaaattgacatttttaaaaaatgcaactaagtggttaatagtgtgtgacgctcaaagttaatgtaaactggaaaggttgtgtgtcgttgctttttgtgttttggttaggcttggttttgttttttaatttttatactttctaataaatttgcagtttcattctt

SEQ ID NO: 3195 - DNA, 965 bp, Homo sapiens
agcaacgacgccgggcagcgggagcggcggccgcgccatgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgccccaaggctaagtcgaaatgtggcccaaccttcttcccctgtgccagcggcatccattgcatcattggtcgcttccggtgcaatgggtttgaggactgtcccgatggcagcgatgaagagaactgcaagaacggcctctgtattgacaagagcttcatctgcgatggacagaataactgtcaagacaacagtgatgaggaaagctgtgaaagttctcaaggcctgcgtggtatgaccttcctccaccgccctactcttctgacacggaatctctgaaccaagccgacctgcccccctaccgctcccggtccgggagtgccaacagtgccagctcccaggcagccagcagcctcctgagcgtggaagacaccagccacagcccggggcagcctggcccccaggagggcactgctgagcccagggactctgagcccagccagggcactgaagaagtataagtcccagttattccaaagtccatatgggttaatctgctctgacttgttgccattctaacaatttgtgctcatgggaagctctttaagcacctgtaagggtgtctcaagttacagtttgggatattaactatctctgcattcccctcctcccccagacttcagagatgtttttctggcgtctcagttgacatgatctgttgtgcgtcttttctgtcaggtcactcttcccttgggacccgagatcacaccctcatttttcacattattctgtttctgtt

SEQ ID NO: 3196 - DNA, 3260 bp, Homo sapiens
gtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggcccgggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattatt

SEQ ID NO: 3197 - DNA, 1042 bp, Homo sapiens
gtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggcccgggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcaggaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggagatggatggtccatttgctgcatctgttccaagagggaagctaaggagtttagtgaaaccagttgaactcgtggaagcagagagtggaatggcggttactggaggctgtgcgggggacggactg

SEQ ID NO: 3198 - DNA, 1678 bp, Homo sapiens
tatatttgtggaaatctgagtgcatgtgacgactgctatttatgggttttgtttttatttttaaagacagggtcttgttctgtcccccaggctggagtacagtggtgtgatcacagctcattgcagtctcgaactcctgggtccaagccatcctcccaactcagcctcaggacttacagaaaaggatgcgcctccacttagcaaggctgggcaggatgtggttctgcatctgcccacagacggggtggttctagacggccgcgagagcacagatgaccacgccatcgtccagtatgagtgggcactgctgcagggggacccgtcagtggacatgaaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggatgtttgcacacttgctcacgctaccacttcttctgtgacgatggctgctgcattgacatcacgctcgcctgcgatggagtgcagcagtgtcctgatgggtctgatgaagacttctgccagaatctgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccagatagtagttcctcagggaagaacagaaaagaggaaagttatatatttgagtcaaagggtgatggaggaggaggggaacacccagccccagaaacaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatata

SEQ ID NO: 3199 - DNA, 4112 bp, Homo sapiens
ggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgcgttgctcttgcttttcctcgctggggtgtacggaaatggtgctcttgcagaacattctgaaaatgtgcatatttcaggagtgtcaactgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttg

SEQ ID NO: 3200 - DNA, 4092 bp, Homo sapiens
agagcgcagggagcagccggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgcgttgctcttgcttttcctcgctggggtgtacgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtagaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgattttttcaatatattttattcctgggggggatcatgctacactctcaaaagaaaattaagaaatcattcagatcatcccccctttttaagtagtgtgaattgcaaaacccaacatattttttttactgtcagttgcggtttatttattctttaactgtctgttttagtagtttaatgattatgaaaaatgtatctgtgtgtgatttgctatttattaaattttaagtactttgctgaatgtcattttaaagcatgtttgaagtcttgtgtatttgtctgtgttaatgctgtcaggaggaactgactaagatgttttaatatgtatcaaaaattaaaatgattttttttattgccttgaggtactttttaaatcaaa

SEQ ID NO: 3201 - DNA, 9899 bp, Homo sapiens
agggaaacttggaggctgcgaccagggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaa

SEQ ID NO: 3202 - DNA, 10313 bp, Homo sapiens
agcactcggcgctgtcatggcggccgggagcagcttcagtgggcacacgacagccgcgcgacccgtggcggggcgagctgtggcagtagcatcctcaccactcgcagcagcctcagccgcggcgcccgtagcgccagcagcggctgcttttgcaaaggctgagcgcaggggcggggcgggccaggaagccatggagttctgtgcagccgcggactcccggggagcggactagggaaacttggaggctgcgaccagggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcatcattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaactttgatctctatttctcttgcaacagacttcaagtggtccctctttttttcctacacactcagctcttctctaaaagcaaggatttggaatgaacaattcagtttgacagaaaaagctgaataaaatggcatctgtaattgaattgttggaaatgccttttttgctcctaaattttaaacatcattaataaaataatgattcacaaagaaagaaaa

SEQ ID NO: 3203 - DNA, 2585 bp, Homo sapiens
ggatttttaccaaaacagcattttgcggctcaggcccgtgctgttcgcagctgttttcctctaatatcagccaggtggccgccttctatgttcccctccccatcccgttgtatgacttcagccttcggattctaagctcctggctgctttccacattccactccccttccagaacccaggcatcctgggctccagctgaaaccattgcatgtggctttccccatccctggccccgtgactcagtccctctgaagggagcagccctcttttttggcaatcaccagggaggtggggggaggaggaggggagctaggtggtgacatcacagtcgaaggttataaaagcttccagccaaacggcattgaagttgaagatacaacctgacagcacagcctgagatcttggggatccctcagcctaacacccacagacgtcagctggtggattcccgctgcatcaaggcctacccactgtctccatgctgggctctccctgccttctgtggctcctggccgtgaccttcttggttcccagagctcagcccttggcccctcaagactttgaagaagaggaggcagatgagactgagacggcgtggccgcctttgccggctgtcccctgcgactacgaccactgccgacacctgcaggtgccctgcaaggagctacagagggtcgggccggcggcctgcctgtgcccaggactctccagccccgcccagccgcccgacccgccgcgcatgggagaagtgcgcattgcggccgaagagggccgcgcagtggtccactggtgtgcccccttctccccggtcctccactactggctgctgctttgggacggcagcgaggctgcgcagaaggggcccccgctgaacgctacggtccgcagagccgaactgaaggggctgaagccagggggcatttatgtcgtttgcgtagtggccgctaacgaggccggggcaagccgcgtgccccaggctggaggagagggcctcgagggggccgacatccctgccttcgggccttgcagccgccttgcggtgccgcccaacccccgcactctggtccacgcggccgtcggggtgggcacggccctggccctgctaagctgtgccgccctggtgtggcacttctgcctgcgcgatcgctggggctgcccgcgccgagccgccgcccgagccgcaggggcgctctgaaaggggcctgggggcatctcgggcacagacagccccacctggggcgctcagcctggcccccgggaaagaggaaaacccgctgcctccagggagggctggacggcgagctgggagccagccccaggctccagggccacggcggagtcatggttctcaggactgagcgcttgtttaggtccggtacttggcgctttgtttcctggctgaggtctgggaaggaatagaaaggggcccccaatttttttttaagcggccagataataaataatgtaacctttgcggtttaagaggataaaatggaggatattattatgtgggtatttatatgacctttgtaaccatttaaaaatgtaaaaacgacctgacttagtaatgcgaacctatagtagcagctactccagaggctgaaatgggaggatctcttgagcccaggagttggagtccagtccagccagggcaacacagccagacgcccttgttttttattttgttttgttttggttttttgttttttgaggagtttccctctgtcacacaagctggagggcaatggcgccatctcagctcactgcaacgtccacctcctgggttcaagcgattctcctgcctcagcatcctaattagttgggattacaggcgcccaccaccatgcccggctaatttttgtgtttttttagtagagacggggtttcaccatgttgtcaggctggtctcaaactcctgacctcaggtactccacccgccttggtctctcaaagtgctgggattacaggcataagccactgtgcccaggcagacccccttctttaaagatgtaaaacccggccgggcgcggtggctcacgcctgtaatcccagcactttgggaggctgaggcgggcagatcacgaagtcaggagatcgagaccatcctggctaacacggtgaaaccccgtctctactaaaaatacaaaaattagccgggcatggtggtgggtacctgtagtcccagctactccggaggctgaggcaggagaatggcgtgaacccgggaggcggatcttgcagtgagcggagattgcaccactgcactccagcctgggtgacagagcaagactccctctcaaaagaaaaagaaaaaagatgtaaaaaccattcttagtttgtgggccttacaaatcaggccactggcccattgcttgtagttagttgatccatgtcatgcaccctaaaaatggctctgtcactgtgagtggcttcagtaggattttgagaataagtttatattcttgctaggtaaaacaaaacaaaaacgacagtaataccaaggaatctccccccccttttaccctccatttgtgtttattgcatatccactataacaacattaaaggacctttaaaaggaagtaa

SEQ ID NO: 3204 - DNA, 1033 bp, Homo sapiens
gaaatgaaagaagggggagagggagggagggagggagagaaggagcctgaggcagatatggaacgatctctgcagaggaattacaaagaaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccgga

SEQ ID NO: 3205 - DNA, 1891 bp, Homo sapiens
ccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaatgaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgt

SEQ ID NO: 3206 - DNA, 1776 bp, Homo sapiens
atgcaggctccgcgagcggcacctgcggctcctctaagctacgaccgtcgtccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaatgaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccata

SEQ ID NO: 3207 - DNA, 594 bp, Homo sapiens
ccagtctgtcgccacctcacttggtgtctgctgtccccgccaggcaagcctggggtgagagcacagaggagtgggccgggaccatgcgggggacgcggctggcgctcctggcgctggtgctggctgcctgcggagagctggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccaggactcctgagtctcctttctgggcacagacctgccctgctgcatctctgacctcgtcgatgt

SEQ ID NO: 3208 - DNA, 2022 bp, Homo sapiens
ggtctgtgcacgggttgcctcgtttctggccttcccttgccttgtacctcgacttcgcgcgtggcttgtttttgctgagtggaggcctgcgttttctgttatgtctcttccggtgccccacaactcctgagctacccttcttttatgcgttctctcccagcgctgtgattaccgggttgcttaccgggccctccttcctcagattgcacccctttccttgtgtctcttcttgtctttgtgtcggttgtgattttcctaatctctgattttccttttctctcggacgctctccctcttcggacccattttctcccgtgcttcatgccctgatagcctggccccttcccggcttccttcgctaccggggacgcctctagtttttctgaatttctggctggctccaccctccgcgttcatcttcctcaagagttcgcccctctgggggctcctctgtgtaatcgtcgccttctctgggtatttctgtgaactccgtctcacaccatcccgccatcttctctgccttggccccttttctctgtacagccagctctgtgtccttttcttctccccctctaaaatcgactcctcttctccctgagagccccacctttgtgccccactcctcattttcctacgcctccctctctctgctggtcctctctctccctgcaaggttccattccatcaatttgtttgtcttttgtaggggtggcatcccctctgactactgctccatcctttttttttttttttttttttttttgcttgaggatttcacttcaatcttttctggttgcgtctccacttgtactcagcttgttaggtccaggtccagttgttctgcatctgaggctggcgtgtgctgtcttctctgattggcctaatctccctcacccccgtgagatctgttgtcagccttcgtttctctttcctgtgtcccagcttttctgcgggtcttggcacctttcttggccacagatttctgggttacagagcatgtgtgtctgaggcattgcaggcagaaaagggtggccgacgtgacctctagctggactgctgggcaggggagctgtcctagataaaattggaaagaaacagtgacccagagacaggtggacaaagaattcggggactgatgggaactgagcttgggatccagactgaaactgattccagactgacctctagcacccaggacccagacacagggccatgggaccccagcatttgagacttgtgcagctgttctgccttctaggggccatctccactctgcctcgggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttc

SEQ ID NO: 3209 - DNA, 705 bp, Homo sapiens
atgggaccccagcatttgagacttgtgcagctgttctgccttctaggggccatctccactctgcctcgtatgtcctgtggggctggatgctataagacccagaaagggactgcaaggggagttgtgggctttaaaggctgcagctcgtcttcgtcttaccctgcgcaaatctcctaccttgtttccccacccggagtgtccattgcctcctacagtcgcgtctgccggtcttatctctgcaacaacctcaccaatttggagccttttgtgaaactcaaggccagcactcctaagtctatcacatctgcgtcctgtagctgcccgacctgtgtgggcgagcacatgaaggattgcctcccaaattttgtcaccactaattcttgccccttggctgcttctacgtgttacagttccaccttaaaatttcaggcagggtttctcaataccaccttcctcctcatggggtgtgctcgtgaacataaccagcttttagcagattttcatcatattgggagcatcaaagtgactgaggtcctcaacatcttagagaagtctcagattgttggtgcagcatcctccaggcaagatcctgcttggggtgtcgtcttaggcctcctgtttgccttcagggactgaccatctagctgcacccgacaagcacccagactctttcacataacaaataaaatagcagagttccctttc

SEQ ID NO: 3210 - DNA, 2500 bp, Homo sapiens
gatgcttaggactcagtaaggagaaccagccaggcagcacatcacagcgggaggagctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccccgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggagcacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagcc

SEQ ID NO: 3211 - DNA, 2472 bp, Homo sapiens
gatccgctttgcgcatcccagtgattcttgggttccgcgtgtagtttcggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacgcggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatccccggggagggcaaaacagccatgtcgtgccccgatgaagagcaattctgatcacagctgttactcactgagcaccagccaggcaccaggcaccccataacacggcttcctgtgctctccctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggagcacaaggagtgcaggacactttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagcc

SEQ ID NO: 3212 - DNA, 1172 bp, Homo sapiens
atgaggctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatg

SEQ ID NO: 3213 - DNA, 1306 bp, Homo sapiens
ctctgctggagcaggacttcagagtgtttgttttcagcctgcttttaaagtgatttgaagagagtggctttgaagattatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 3214 - DNA, 1577 bp, Homo sapiens
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcagggaggagccgcgccccgccccgcgcggtagcagccaacgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttgctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgtaaa

SEQ ID NO: 3215 - DNA, 1248 bp, Homo sapiens
cgccggccccaggcgggtgcgctgggagcctgggccgggagccgggtgagggcgccgagaggctcggtgggcgcgggcggcgagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaa

SEQ ID NO: 3216 - DNA, 992 bp, Homo sapiens
ctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctga

SEQ ID NO: 3217 - DNA, 992 bp, Homo sapiens
ctggtcagctgcgtagtaagtgagaagggaggggctaccagaggcagggaagggaggagcctttgggtttataaattccaaaaaggccactcaactcctagagctggatccttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgtaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctga

SEQ ID NO: 3218 - DNA, 992 bp, Homo sapiens; identical to SEQ ID NO: 3216

SEQ ID NO: 3219 - DNA, 992 bp, Homo sapiens; identical to SEQ ID NO: 3216

SEQ ID NO: 3220 - DNA, 992 bp, Homo sapiens; identical to SEQ ID NO: 3216

SEQ ID NO: 3221 - DNA, 992 bp, Homo sapiens; identical to SEQ ID NO: 3216

SEQ ID NO: 3222 - DNA, 992 bp, Homo sapiens; identical to SEQ ID NO: 3216

SEQ ID NO: 3223 - DNA, 937 bp, Homo sapiens
atgaaagcccttatgctgctcaccctgtctgttctgctctgctgggtctcagatggttgcagtgacatctaagagcctccatggaaacagagcgttttcttgagccttctgaagaggggacaactgggccacttacctccagggtgaagtggatttcactgagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgcaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccatccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaacccaggctcccatatgtaccccatcccccatactcacctctttccattttgagtaataaatgtctgagtctga

SEQ ID NO: 3224 - DNA, 937 bp, Homo sapiens; identical to SEQ ID NO: 3223

SEQ ID NO: 3225 - DNA, 920 bp, Homo sapiens
gagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagagatgcctcgattcctcagttcaaacccgaaatccaggtctatgagaacatccatttggcccgtcttggcccacctgcccacaagcccaggtgatttt

SEQ ID NO: 3226 - DNA, 920 bp, Homo sapiens; identical to SEQ ID NO: 3225

SEQ ID NO: 3227 - DNA, 920 bp, Homo sapiens; identical to SEQ ID NO: 3225

SEQ ID NO: 3228 - DNA, 920 bp, Homo sapiens; identical to SEQ ID NO: 3225

SEQ ID NO: 3229 - DNA, 920 bp, Homo sapiens; identical to SEQ ID NO: 3225

SEQ ID NO: 3230 - DNA, 1193 bp, Homo sapiens
gggacaccaggtcttggagcaagagaacttggcaggctctccccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatag

SEQ ID NO: 3231 - DNA, 1193 bp, Homo sapiens; identical to SEQ ID NO: 3230

SEQ ID NO: 3232 - DNA, 1193 bp, Homo sapiens; identical to SEQ ID NO: 3230

SEQ ID NO: 3233 - DNA, 6886 bp, Homo sapiens
ccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcggcatttaacttacatttgtactttatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaa

SEQ ID NO: 3234 - DNA, 5454 bp, Homo sapiens
atgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 3235 - DNA, 5622 bp, Homo sapiens
atgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 3236 - DNA, 1356 bp, Homo sapiens
cttttcactctgctttgggtgttgaaggaagacgagcttctcacggagcctctcttgagcctcttggcagtttccccctctgtgcccctcacgtttccaccagaaacgtgaaggcagaggccacagattctccctgagccacctcacttggaagcaccatgtccggatgagatcgcacttcctgcagtgggcattagccacgtccagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggtgggtatctatgacaacgccatggtcccccagatgtgtgggaacctcactccctcggcacactgcatcaatgtcagagcttccagagactgcgcaagcatttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtcta

SEQ ID NO: 3237 - DNA, 3023 bp, Homo sapiens
tcttttcactctgctttgggtgttgaaggaagacgagcttctcacggagcctctcttgagcctcttggcagtttccccctctgtgcccctcacgtttccaccagaaacgtgaaggcagaggccacagattctccctgagccacctcacttggaagcaccatgtccggatgagatcgcacttcctgcagtgggcattagccacgtccaggtagaaccaaacctgttgcttttgtatgttgggtcaacttggcctgacgtttcagaggtagacacgagatagggagtttgttgcgggggtggggagaagtggtagacatgctggctaactgattatgattaagagaaacttagaagctgaagccagagagcatctcaaaggttcctgatacaatggatggtgtcactccaaccctttcgacaatcagagggaggaccttggagtccagcactctgcatgtgactccccgcagcctggacagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggtgggtatctatgacaacgccatggtcccccagatgtgtgggaacctcactccctcggcacactgcatcaatgtcagagcttccagagactgcgcaagcatttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtctatcccataggattgactactgcagagtctagtgcagacccgtgatcaccttagtgcttcagtggattcactggttagattaaaaagaggctgagatgagcagtgaactaagaggccacacaaaagcagaggtttgggaattccagaagggaattcttctcaagcagagtgtggttatctcctgtaccagcctaagaatgtttgctgaaactgcttcctagaactgtgaagaaagcaggaaagtagtgcacagtagtctaagattattaccttcattaataccaacaggctgcaaagcaagagtatagattattgtataatccagtcagaggtcaaaaggaaggaagaagttggagtggagtggggtgggcaatttccattttaaagagtgtaggcaggccaggtgcagtggctcatgcctgtaatcccagcattttggtaggccgaggagggcagatcacttggtgccaggagttctagaccagcctggccaacatgacccatctttactaaaaatacaaaaattagccaggcgtggtggtgtgcccctgtaatcccagctactcaggaggctgaagcaggagaatcgcttgaacccgggaggtggaggttgcagcaagccgagattgtgccactgtactccagcctggtgacagagcgagactccctctcaaaaaaaaaaacaaacaaaaaagaagtgtgggcaaccaaatgtaggtaaggatgaagaagaacaggaactctcactggtggctgatgggattgcaaagcgtcagggcagctttgaaaaacttttcagcagtttcttataagcataacttatcatatggcccagccatttcactactagaaattgacgcaagtgaactgaaaacttatgttcacacaaaaactcgcacatgactgtttatagcagcttcattcataattaccaaaaactagaaataacccagatatccttcaacaggtgattggataagctgttgatatccattccttgagtttatccatactcaacagtaaaaaatgaactcttggttcacacaataatatagacatatcttaaatccattttgctaagtgaaagaagctaggcctaaaagtctacatgttgggcgattctatttatatgacattctggaaaaggcaaaactatagggatgaagaacagatcagttgttgtcaggtttgagaaaaggagggaagtttgctacaaaggggctgcaaagggaataggctgatggagctgttctgtatggtactgtgtggtggatacatgacaatatccatttgcaaacacaagaactatacacatggccaggcgcggtggctcacacccgtaatcccagcactttgcggggccgaggcaggggaacacaaggtcaggagatcaagac

SEQ ID NO: 3238 - DNA, 1626 bp, Homo sapiens
ggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 3239 - DNA, 1659 bp, Homo sapiens
gcctggtgtggggacgctcaggtgccggcgtggggccccctcggaggctgtgaatcttttggacccccgaatgtaaatgggagatgagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtgaagtagtatttgaagcttttcatcagttggctcattctttactcaagaataaacctcaagaaacgtcatcagggtcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaa

SEQ ID NO: 3240 - DNA, 1394 bp, Homo sapiens
ggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 3241 - DNA, 1558 bp, Homo sapiens
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgaaattggactgcattacaagattccttacccaaggccaattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatc

SEQ ID NO: 3242 - DNA, 5353 bp, Homo sapiens
tcctgcgcgctgaggctccggcggacctctggtggacatggctgcttcccgcttacccccagcgacgctaacgttaaagcagttcgtaagaaggcaacaagttcttctcctctacagaaggattttgcaaacaattcggcaagttccaaatgattctgatcgcaaatacctgaaagattgggcaagagaagaattcagaagaaacaaaagtgccaccgaagaggatacaatccggatgatgattactcaaggcaatatgcagctcaaggagttagaaaaaacacttgctttagcaaaatcttaactatagcattattctgaaggattttcaaagtctccatgtgttttgttgcatttaggattaacaatggacaacacaaagcccagtcttactatttatatgtacagtatttggtgatagagagcaaaggaaaaacacatcagaacagttgccttaacactgaaaaacataccctgcattttgaaaatgtttatggatgtctcagcagttcttaaaagaagaaaaaaaccactaacaaatggccagtagatgctggacacaatcattagggaagtgtaaatcaaaactactatgaggtcgggtgtagtggctcatgcttgtaatcccagtactttaggaggctgtggtaggtggatcacttgaggtcaggagttcaagaccagcctggccagcatggtgaaacctcatctctactaaaaatacaaaaattagcttggtgtggtggtgcattgcctgtagtcccagctacttgggaggctgaggcaggagaatcacttgaacccaggaagtggaggttgcagtgagctgaggtcgtgccactgcacttcagcctgggtgacagagtgagacagtctctaaaaaaaaaaaaaaaaaacaaccctgagattcacattcactagaatggctgtaattaaaaagagaaataataataagtcttggtgaagatgtacagaaattacagaaccctcatacattgctggtgggaatgtaaaatggtgtagccacttcagaaaacagacggtcagttcctcaaaagatgaaacagctgctgtatgagttagcacttctaccccatgcccatagccattatttggcactaaaaagaaacgaaggacttatatatactaaacatggataaaccttgaaaacgttaagtgaaagaagccggtcacaaaagatcacatgatgattccattcatacgaaatgtccagaataggcagaaagattagtggttgcctaggctggctgtagatggaatggagtaactgctaatgggtgtagggttccttttcagggtgatgaaaatatcctacagttagcttgtggtgtaggctgcacaactcttgaatatattcaaatccactgaactgtacattttaaatgtaaggtatgaattgtatctcaataaagctgttattaaaaaactcttgaggtgtaggactgaaagtatactgacaccaggagataccctggaactttctcgaaaaatcctgcattatccctgagggttgttcaggtacgttcttcagatgtgtcatagtttgatagagaactcatcaaaaagatcaccactgggaatctagatctttgttgaaaagggaagagaaagagaagcttaatgagcacattgaagcacttaccagaaagaagagggaagacttctggatgaaacctctgtgagtaccttaacattcacatggaagtagtaaaaataagattctgggtgcagttctccaatgacaggaaaaaaaacaaagagaatttgaagaatacgtcagagacaaatacattacaaccaaaattgacttcaaggcacttttgaaggagatcaaatttataacaaaataatttagtgaaagtgaaagcttgtggaagatgttggaatcatccatcctgaaaattgaagtcttctgtttatcaacagaacagctaagaagctaatctaagaatgaccagcacctgaaagatgtagacaacattttgcagaatgataaatggtatccagtactggactgtgtctgagaggcatcaactgaatgtggatgttaatgacctggactgtcagggtccacctctacctcccagagcctcagagcccacaagacaaaataattctgaatactgttccatgggggtaatctactaattcaaaatgcctgcctgtgccaattttcaggtttttatgtagataagtattagttaacctgttgcaaaatgatctgacaaacagaagcatttgtgacgtttctgaacagagaacactttggaaatattttttgtgtgacatgattgatagatacatgctatctctagtaaatctaaaatcttgaaactcaaaatcatccttttatgggtgtagaagtcagtgatttaatgatgctcttcctaacagtggtgtgcatggaaaggttttcattaaagagcgtatgtggtttgcatttgcaagattcaactagcacagactccaagaaaacctaagtttttttgttttttaaagcaggtaaggccgggcactgtggcttacacaagtaatccacacactttgggaggctgaggtgggtggatcactttaggtcaggatttcgagactagctaggccactagctagcctaacctggtggcacgtgcctgtaattccagctactcaggagggctgcctcatattgaacccgggaggcagaggctgcagtgagccgagaacacactactgcactacagcctgggcgaaagagtgagactcttgtctcaaaaaaaataaaaaagtgccatcaagttagaagttttaaattcatggtacaagcattgccatagatgtgcctgcaagaaacacacagatgacttttttttgagacagggtctctgttgcacaagctggagtgtggtggcgcgaacatggctcactgcaaccttgagctcctgggctcaagagatccacctgcttcagattttcatttagctgggaccacaggcatgtgccaccatgaccggctaattttttttacttttcagagagaggagggggaatctcactttgttgccaggctagtctcaaactcctgggctcaagcaatccacctgcctcggtggccagagtgctaggattacaggtgtgagttgtttttttttttaaagagacagtcttacctcattctgtcacccagaatggaatgactttctaaaattgcagaaagcagaacatattccttgctgtttataatattatagtcgtatcaaagggaaagagtatttctccttaaataaaattacaaataagaaatgtatgttttactcttactcataaaaggtattgtagaatacaaaaggtttttcaaactggttttgtctttgattggcttttataatccacacttcaaagaagaaatgcatttaacttttaataacttagtcaaaaagtataatgttgccttgccttgcataacctttaactattgcaaatgatgttttgtccttcccctttgtccagtattttccaaatggtcaacagtttaaacatttaagcttgcactgagaaaccttgccacatttcagcagttttgttttgcttttggtggagagcacctgatcgcgactttacagccaatgtatttactctaaattacacttttatagatacaaggtaaagtgtagctgggtgaaggcactcaggagccataaaatgtggtcaaccacaataaattaaaatgtaagctaaacaaagtattcacacttgcatttttttaataaggaatttaagatccatagtatctttaatgcttggaagagacacaaattcaaggtgataaaaatattaattagaagacacataacatgcctcaagtatatcaacacttgactccacaaacaaggcataaccatgaaaacaacactccctttattttgggctcccaaaatcaaaagttagaactaatttatttaatcacagatatttagtatactcaataatgcactaacaatttctttaaaaaaacactaatactgtacagtatttctgtgttttagtttttcccacagctgttgaaaatttcagccttgatttgaaacatgacctgcatgacaggctataagttgtcaatagttctttttctttggaaaagtacagttgtggcatttactcactttagcagatagctaaaagggaaaaataaggaaaaatatacactggacctgcagttaagtttttgacaatgccaaggatcaaaaacagatgaaacaacatttgctgaagatgaaaaggtattgcattggtcttaatagatgttgccatctctgggtgaggatgctgactgagcctgttctgtgtcttcatcacctctatttgtttcttcttctacgacagacctccaagagacaagatccatgtagtaagccacactaggtccttttgacccttctcattcttctgtagtctcttccctgtgacttttgacaaaaatactcagttcacaatattagctgcctgcttctgatgggtaggaggtaatcaaaatactcccaccaaagcactctatggtctagacttgatacttaaaatttagttttcagcattcctcaacaaggataccttgaggtaataggagatattttggtaagtgaaaataattcctgcttggaacacagcctactgaactcaggatttaatttcttgagtattaggcagttctcaataaattgatgtatactgaggaatgattctaaagaggttagtgatatcctgtttgagaatagatttagaaaactgaaggtactctccagctctacaattctgtattaggaacaatagggaaatgagaaagtgcctctatattgcaatctaatgagtctctgggggaagactgtctacctgcgtagtagttgagaacaagacaagctcccaaacacatgaaaatcaacttgaaataacatcaaattcagcctgggcaatatcatgagaccttatatctacaaaaaattagccaggactggtggcacacgcctgtagtcccaagctacttgcgaggttgaggcaggaggatcacgagcctgagaggccaaggctgcagtgaggtgtgatcatgccactgcactccagtctgggtgacagagcaagaccctgtctcaacaaaataaaaaacatcaaattcattccatattcaggtaacagtgacatatatctactgaattatttttcttttaggaatgtctatatctatggattgtcactataaaaaaaagaaaaaaccctaaaactgagcttgacaaagggaataaaagcatactttgtttttcttggtgtccccatgttaataaatcatttcttctctttggctcaa

SEQ ID NO: 3243 - DNA, 1134 bp, Homo sapiens
ggccggcgccccgccccctttactgacaggttgcccacctcccccaacgccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcct

SEQ ID NO: 3244 - DNA, 233 bp, Homo sapiens
tgggaggcctgggcctctgcggtttaatccagcagggggatggggctcattccgcaatttaaagagagaaataagttggctccagagggtatgttatgcataaaagtggataatttacatgataaatgaaaatggccaattctttaagaggagaagtactaaaactttataaaaatctgctgtatcttggacgagactatccaaaaggagcagactattttaaaaagcgtttg

SEQ ID NO: 3245 - DNA, 838 bp, Homo sapiens
gcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtaaaaaaggtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacattt

SEQ ID NO: 3246 - DNA, 1086 bp, Homo sapiens
ccaccccgcttcgcagtagacggacagaggagtcgtagcggtcgaggcttttgcggctccggcgtgccggaaagtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatccta

SEQ ID NO: 3247 - DNA, 833 bp, Homo sapiens
gcttcgcagtagacggacagaggagtcgtagcggtcgaggcttttgcggctccggcgtgccggaaagaaaacgtcaattatgacagcaggtaattttatcggaagtgtttataactatatcccagtacgtggaacgaaaaagttatcaagaaatatttattgaatgtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaata

SEQ ID NO: 3248 - DNA, 1138 bp, Homo sapiens
ggccggcgccccgccccctttactgacaggttgcccacctcccccaacgccaccccgcttcgcagtagacggacagaggagtcgtagcggtcgaggcttttgcggctccggcgtgccggaaagtgcgtatgttatgcataaaagtggataatttacatgataaatgaaaatggccaattctttaagaggagaagtactaaaactttataaaaatctgctgtatcttggacgagactatccaaaaggagcagactattttaaaaagcgtttgaagaacattttccttaaaaacaaagatgtgaagaatccagagaagatcaaagaacttattgcacagggcgaatttgtaatgaaagagctagaagctttgtacttccttaggaaatacagagctatgaaacaacgctattattcagataccaacaaaactaattgatcattactactttaatttagctatcagtgccagctgtttatgtataccagatgttgtaaaataattctaacttaaaatgggaagatatacatgttgtgtaaaaaatccctgagctgccctactgaactaaataggtttcaacttctgttcatacggagaaagtatcagcaactttatgctcaattttgatacaaacatagcaatttagctatactaccgatcataaattaatgagcacccaattttgaatgaaaatataatacacttaatcctctaacttaataggacttagccaattatttttagcttatttctccattttactgacaagagaatgccatttaccgaacatttaataagcaaaataatttcttacacacttacttctcttaacttttgaaaggaatcccttattttttcacccaatttggtatattaacagcacatactcaaggttcactacaaaacaaacagttcctggtaatgatttaaatgtagttatagaaataaataatatgtatggagtcattacttctgaccttgaaatagcctgctggtgactggcattaacatacataactaactattcaattatttccattattaatgttgctgctgctacctttgggcctaaaaccaagtcacctgttgtgtatcaattaccttctttgataaaaggaaataaataaataatgttatcct

SEQ ID NO: 3249 - DNA, 6351 bp, Homo sapiens
agcaaacgcctttagcaaacgcccgtttagcaaacgcctcctccgtcctttggaggagggcggggctaaaagggagatgctgcctagtgattcgttgtggcgcattagtaacgcgactacagggggctggaaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagcagccagaataaagataaatgaagaattcaaaaataataaaagtgaaacttcttctaagaaaatagaagagctaatgaaaataggttctgatgttgaattattactcagaacatctgttatacaaggtattcacacagaccacaatacactgaaactggtccctaggaaagaccttcttgtagaaaatgtgccatattgtgatgcaccaactcagaagcaatgagttttctagaatacaacaagtctttgtactttttaactttaaaatctacaactctggcaaaagtcctggaaatgcagacattttccctgaactggcatattgaaaatgaatgaattacagaatagcttcatatttaaatttcatgttaaaaggtcattactgagaactaaagaacataattaagtatttctaaaggaaattagataagaaaacatttcattttcattgaaaatcaaatttcataaagcaaagtaaatgcttagggagatatattcaatctttgaccttgatgagtatttgatcttaccatagctatttgagaatgtggtgcttttacaaattggtgagttttcctgccatgtgaaatgcaattattacatttaaattgttagattaaaatgatatttagtcctgaaaaatattaaattggtcaaaaaaatcacagtgtatgccagctctctacagaaagtggcctttgttttctaaagcactgggattatttctgtagctaatatataattgtacagtttctttttagagatagagagtatctctgtgttcttatgaagacattttttatcagttttctgaaaatagatgaataaaatattatagtcacctagggtcactatggaataaagaaatcctagtttaaagaggaaatagtggcccttgatcaaactatttaatatggccttagtagaattagctgtatttagacaaagttagactttagtgtgaaatgtaatcggtggctacattctcatcgttttaattaatgaaacttaaatggcttctcttcttccacatgtcctgtccttgacaagatgggcagtatcacaaaaggtcctggcattctaccatctaacactaggaactgtaaaatactgtttaatattcttcttgtttctcttttatctgtgtatctttgccattctattttctcagtgaatagtatgttttctcccattcactgataaattctctcatttgatgatgatacagggtttttaatttttgcaagattctcaatgcaagcattgttatgtatctagaaattatacctagagaaaaatgaaagtcgtttcaaatttgaaatttgcccttttaagagaatgctgaatgtcatcgcagtatataatcactatataaatgtgctgacttacagttattttagtgtctatatgacatattttgaggaaagttggctgacgttatttaaatttaatatatattctatattttagtgttattgaatattttatcactgagcttttttctttaacctgaattccctgttccatttttcattcatattaatttaaataactccagatttctttcttatagtcattattagtagcagatgagattaataattcacatgtttattaaagatagtggcttagaaattttaagatatattgatataggcccgggcgctgtggctcacacctgtaatcccgcactttgggaggctgaggcgggcagatcacaaggtcaggagttcgagaccagcctggccaatgtggtgaaaccccatctctactaaaaacacaaaaattagccaggtatggtggcgggcgcctgtagtcccagctactcgggaggctgaggcaggaaaatcacttgaacccgggaggtggaggttgcagtgaactgagattgtgccactgcactccagcctgggggacagagtgagactctgtctcaaaaaaaaaaaagaaaaaaaaaggaaaaaggaaaaaaaaaagatatattgatacagataggtagatatgatattgtactttcatgccataagactacacaataaagttcctgaaagttcctggctgggcgcagtggctcacgcctgtaatcccagcactttgggaggccgaggcaggcagatcacctgaggtcaggagttctagaccagcctgaccaacatggggaaaccctgtctctactaaaaaaaatacagaattagccaggtgtggtggcacatgtctgtaatcccagctactcgggagactgaggcaggagaattgcttgaacccaggagacggaggttgcagtgagccgagatcgcaccattgcactccagcctaggcaacaagagtgaaactccgtctcaaaaataaataaataaataaagttcctgtgaagtatataaacatgtcaacaacaggcttgactgtcacaaaattctgaaagatgtcgcactctattcttatatagcatatgctaatttatttatttattttttgagattgagttctgctgtgtcacccaggttggagtgcagtggcatggtcatggtccactaaagccttgacccctggggctcagcagttatgccaactaagcctcccaaatagctgagactagaggtatgcgccaccacacctagctattttttttatttttagtaaggacaaggtctcattatgttggccaggctggtctcaaattcctgagctcagttgatcctcccacctcagcctcccaaagtgctgggattacaggtgtaagccactgcaccctgcctattcttataatcatatatttatatttcaaatggattttaactggttatttaatagtttaattagataaagtaattcatggctgggtgtggtggctcacgcctgtaatcccagcactttggcaggctgaggcaggtggattacctgaggtcggaagttcgagaccagcccaaccaacgtggagaaaccccatctctattaaaaatgcaaaattagcaggacatggtgatacacacctgtaatcccagctagtcaggaggctgaggcaggagaattacttgagccagggaagcagaggttgtggtgagctaagattgtgccactgcactccagcctgagagaacaagactccgtctcaaaaaaagaaaaaaagaaaacttttttacacatgggtatctcaccatgttgcccaggctggagtgcagtagctattcataggcacagtcatagcacactgcagcctagaatttctgacctcaagcaatcatcctgcctcagcctcctaagtagctaggactacaggtgcataccaccataaccagctttaattaaatgttttttatttggttattttttttaagttttctgtattcacacaaggggttgcccaaatataattttgctttgactattgagatctagtgaaagtggggtatatgaattctaattgcaaatatccaggctcagaggcccagcaggactttctaacacaatcttttagcggaagttagaaatggtatatagcaggagagtcagatttgagaagcatatgtagattcgaagctgggggaatatggcaggtagtttgtacaacatctaattcagaacattaaaattaagattttagtcaaactgtgtttaagttagttcttattttcctgtagatgcatctcacagcatcagtacaataccaaaaaagcacacaagaataagaatatgtggaatttctatacctattgacaaagcacataatttaaccataaacacaaagccataggtcaacaaagaaatgaagattccagttctgaaggtgagttttctgaagccaaagtggatacatgcaaaattaatatagttttactgtatatcagttgtcaccaatcagaaatggaaaacagatcctatttataattgcaaacaaaactgtaaaatagactttttaaagtctgggaatagacttctaaaataagctataacacttaaaaaggagagatatactatgttcctagataggacaattgaaaattctggagatgacagtttttcaaaaatctattgaggccaggtgcagtggcccatgcctgtagttccagtactttgggaggcctaggtgggtggatcacctgaggttgggagtttgagaccagcctgaccaacatggagaaaccccgtctctactaaaaatacaaaattagccaggcgtggtggtgcatgcctgtaatcccagctactcgggaggctgaggcgtgagaatcgcttgaacccggtaggcagatgttgcagtgagccgagatcgcaccattgcactccagcctaggcaacaagagcgaaactccatctcaaaaatagaaaaaacatttatcgaaatcccaacaagttgacaaatatatccacataaaaatataaaacttctgtattctgtgaaagctactataaataaagtttagagaaagttatttgccacctatgtcatgattgaaatagttaattgatcctgtgaatcagttagcaaaacataactcaatggaaagataggcaaatgatacaaataagaaattcacaaaagaagaaatactaagtctctagtgatgagagaaatgtaaattaaaatgaaacatgtttgttcatcaagttgtcacaagttagacaatcatatccaatatttttaaaggttgtaagactataaggaaatagccactgtcatatcatttttaaaggaatataaattatagggccttttgtttctttgggttttttttttttagagacaagatctctccgtgttgtctaggctggactcaaacttctggactcaagcaatcctcgcaacatcattaatagctgagagtagagacttgagccaccacacctgactatagggcctttttgaaaggaaaattgacatcatcaaaattttaaatatattcagtctatttctcaaaaactcaaagaatactaataaatgtgtactcaggtatatgtacagaaattgctgtaacattataattttaaacaatttaaaacagactgagtttccaaagttagggtacaatgaaagaaaaggtggcttatttatactctggaatattttccaagagttgaaaaggatgaggatacacacacacacacacacacacacacacacacacacacacacacacagtttgggtatccctaatccagaaattcaaatgctccaaagtccaaaactttctgacccaccaacatgactgatgctcaaaggaaatggccactggaagatttcagattttcagatttggagtgctcaaccagtaagtatataatgcaaataatccaaaatacaaaaaaaaaaaaaaagaaatctgaaacacttctgatcccaagcatttcagaaaacggatgttcatttgtgtgtgtgtgtgtgtgtaagcaggtgttgctagaaattcacttatatacaagaaaactttttgtgtacatatttgcatatatatgtacaaatgggtagaaacgatacatgattaatcttaatcgggaaggaaaagagatttagggaaggaagcagtaagtgagaacttttattctatttactcctgcacgtttaaatattgtttacagtgagtatatcaacatgtaagtgttaaaagacaataagctactagtgatttttaatataaaattaactataaaatattttaaatattagcaaataatatagcacactcatgaacctaattcccacatttgatagttgttacattttgccatgtttgtttaaaggtctaagtcataaaatcttataaagctaaaccccacccttctctttctcctctctctccaggataattactgttttatagtttgtggatatcattcccttacttgtgtttatacttttaccaagtgtgtatgtattcaaaaaacagttgttttgtgattttaaaatgtaaatgaatggcgttatgctccatgtattctgcaacttttcatcatacattaggttttggcgatttagccataatttggcatgaattcaggtcttttaagttttattccattgtaagaataaacaagtttgttcattcatgtctc

SEQ ID NO: 3250 - DNA, 4261 bp, Homo sapiens
ggagacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgatttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaa

SEQ ID NO: 3251 - DNA, 4259 bp, Homo sapiens
gacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaaggggaaagtgatttataattcctacaacagaggccaagaaatagattaaaatattttcaagaccccaaaataatgtattatggttgggaagtcagtagaacactggaataggtgaagacctgacagtaatttttgtcttaagaatgctttctttaggacagaccctttaacctcacctctgtgcatctgtttttaaaatgattatatttgcctctgatatttgaaagcacttttgtagttttgatgatgaaaaatatattaaacgtgcatattaccattatttaggaaataattccttatatactgtgataaatcattgctgttacatacagtaacatgccttaattacatttaatgccttactgctttatgtaagtaaatccaagtttcagaattaaaaataagcattatttcatatggtccaatcagattcgttacataggctatataaatttgtctccattttcaccatcaagcacaaataattgggtcaaaactgcctttgaggtctgttgaagaaaatggttcattaagcaaaaaagagtagaggtattttatattagcagtaacagacaaattatttagtaatcccttaacctctgtttttcaaagagaaaatatccaatttagacttttttcctgatctctatatatagcatcaaattgggaaacaaaggccaaaggtgtatagattgcttgaaagggggtggtagtgcctctttttaagatctgttgagtcggctacagtctggctaagtaagaagcatttgcatactgattccatcatttaatctttaaaagtatgtgttttaaaaatgtaaccagaatgattcttcaatagaaatgagatttggtggagtctggattgcctgttttgtatataatatatacttaagatatataataccacctcattttctgggcattatttcctaattgttgatgtttcaggcttttgataagtcattttatatatttcaaatttaactcagaataagtaaatatttatggcaaatgcagttttatgtactttcaggagaagaccatcaggaaaagacaggacaaagaagtcaaacattaaagcccttgcaaatattagaggaccttagacaattaccaaaaagtgtttaatagggaagttgcaaatgattctcttagtaaattaaacatttaaaaagtagttttaatgtgccttgggcatcttgaaaagaagagtgtgatataatttatgcttagtgttaactggtcattttacattgtatttattaagtctgctgaaaaatgaggttttaaggaagaaaatgcagattattttagggtaaacaggccaggtgtcctttgaagaactttgtttacatcaaattgatgaaattacagtcagtgattccttactttttttgctagttgtactttgaaattgttatgggttcgatttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttgaattaattgaatataatttgagttacatataattctatataaaggttacatattgaattatggttctaatctgtttaggaaagaaatgaattttctaagcatttaatacatttggaataattttagtttctaaaaagtactaatgtaagttaagtttatatcaaatgcaaattaccttgtataactaacaagcacagttattgtttaacattatggattttaattgtgttgacacccttctttgaatttgttgctttacatgtgtgtctgtgtgtgtgtctgcatgtgtgcacgcatgtacttgtatgcaatgtaaaagtaacagcagaatcattgcatttggtttacttaaaattttggagttagcaagtaaacaaaaagctgatagttttatgaagtctcggttaaaataaaatttctttgctatctcactcctaggaagttatggagttcatattttcaaaagatatgttaaaaatggttacacactctgctggccacattaaaaattagaagactcatgttaaattatctcctccaaaggactttttatttacagcttttcttttcctggactctacctgcttggttcagtgtcctgaagagttatttaaatgaaccactacttagtaattagttcttttttaaagtatctacttctaaaattacctagttgaaaatatgaaggatatgcttagttttagaaatatcatgaagcaaggatctagtcagtgttacagggtaaaggtggagttttttaaagtctgtatttaaatggtgcactgatggattcatttttaatttgcattacaaaaatgttgctcaggtaatcagtattttcttccacgtatgtgcatattgcactgttagatcatagaaatatctgaatgctttaatttttatgtatgcaaaatctataaatcttttgtataatgtattttatacaaatgtaactgtagaacattgttagcatgtgtatctgtaaaaccagtttttaaaattttttgccccttatttttcatattttgaaagatctccaacatgtaataaagtttctcttattcaatctaaaa

SEQ ID NO: 3252 - DNA, 1538 bp, Homo sapiens
ggagacgttggcggcagaggcggaggcggacggggtcagcccaaagcagaggctcggccatgaacttacccgggacagcggcggcggcggaccttttggccatcttctcgcagagtgctccctgctaacggggacagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgagagcagttgatccataaatctggtgtgtgaatgtttcaagcagaaattaatttaaatgtgtgtttaggaagtacttaacttggaagatgtatcatttttcttaaaatgcatgtttaaattttatttttttaagtaatttttaaaaagtttattaatgttaaatttatgatgcagaatgatagcatcagatgtctgcagctgaaaaaaatttactactatgaacccccaaaatattcagttgcaagaaaatttgattctaaaattattcatggtaggatacgtaacacaccccttcaaaacttttaaaaaatacatttagcacatgtgctatgaaagcatacgtacaaagagaaa

SEQ ID NO: 3253 - DNA, 2790 bp, Homo sapiens
cgcggtggcagctgcgggtcgcgggtcgcgggtcgcgagtcgccggtcgccggtcgcggcggagcctgggcgctgagaagggacttggagggaagcgggcctggagctgctgccgccgcccctgagctcggacgcgaaggctggccccgtccccgggctgccgccgtggtcctgcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttctgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagg

SEQ ID NO: 3254 - DNA, 2885 bp, Homo sapiens
cgcggtggcagctgcgggtcgcgggtcgcgggtcgcgagtcgccggtcgccggtcgcggcggagcctgggcgctgagaagggacttggagggaagcgggcctggagctgctgccgccgcccctgagctcggacgcgaaggctggccccgtccccgggctgccgccgtggtcctgcagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaacacattttattttagacctaatggggctggagataccaggcagaatttaattccggatttctatgcattcagagtgattaacaatggcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttctgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaa

SEQ ID NO: 3255 - DNA, 2672 bp, Homo sapiens
ggggcctggacgagggggccgcggtctggctagggagccgcgcgggctcatggcgtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttctgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggaggaaaa

SEQ ID NO: 3256 - DNA, 3042 bp, Homo sapiens
gcgagtcgccggtcgccggtcgcggcggagcctgggcgctgagtgaagaaaatgaggcacgaggaattgttaaccaagaccttccaaggcccagctgttgtgtgtgggactccgaccagccacgtatacatgtttaagaatggcagtggggactcgggggactcttctgaagaagagtctcaccgtgtggttttgcggccccggggcaaggagcgccacaagagcggtgtccaccagcctccccaggcgggagcaggtgacgtggtgctgctgcagcgggagctggcccaggaggacagcctcaacaagctggcgctgcagtatggctgcaaagtaagacacccctcaggggccctgccccgctccgtttcaaggaacacggggaactcactgcagggtgggtgcccttgccgcccttcttaaccctgccaggccgtcaggagaggcctgctgtagcagccaaggactcccctatttagccagaattggaatgcaggtgggagtacctttagttcccaaccctggcccccaaagagggagggttagcgcatttctttctctgcagggaacttctccttttcctgttttctccacactgaaattctgaaaccttttttcttctttcgagcacattttattttagacctaatggggctggagataccaggcagaatttaattccggatttctatgcattcagagtgattaacaatggcaaagttgcagatatcaagaaagtcaacaacttcatcagagaacaagacttatatgctttgaaatctgttaagattccagtgagaaaccatgggatcctgatggagacccacaaagaactgaaaccccttctgagcccgtcttctgagaccacagtgaccgtggaactgccagaggcagacagagcaggcgcgggcaccggtgcccaggccggccaactgatgggcttctttaaggggattgaccaggatattgagcgtgcagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactaggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcactgttgaataaagggcagtcctactcctgtccttttagagtggcttagtgtgacacacaggcatctcccaggccaagcacacacaggctgcgcccagttccgcaggagccgtcccacagcgtggctctctggattctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcccggcctccaagagttctggacaggaggcagacactgcccagatgctcggtggagggacagtgatggcctttgactcatgaggcctggagaaaagtatcaaaggtctcaccatgtaagagtgatttccgatttctctcctttcagttgtgtgaaaaaacagctggcctgggttccattagcaaattaaatcatcttcaatcttaaattagaaaccagaatgatcttcaggataaaaagaacttctgaatctctgcaataggaaatgtttcgatcatgcaagtgctttcccagccaaatgtctgtgctctctgtgtcactgagggccacaggttcctctaacatctgtcactgtcacttcaccaggcaggccttggagttccatgacaaaatcacttttgtcagacaaagaatgtatcctttacttttctcaaatggaataaaattatttcttctgtggagg

SEQ ID NO: 3257 - DNA, 5387 bp, Homo sapiens
agagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaacaaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttgcccaaagtagcaatattcttaaagatgttgaattttgactggttgaattttatatagtaacacacaagtcgtgatcatcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaa

SEQ ID NO: 3258 - DNA, 2035 bp, Homo sapiens
ggcgggggacacccgcccccgctctccgcagccgcccgccgtccgcgcccgccgaggtgagcccggcgcgcgggccgcgcccgccgccacgacccttccacatccgcggaaaccgctgcaggctccaccggctccccgcgctgcggtcgcctcttctctgcccctttcatcatcccctgcttccttgccctctggtcggaaatctcattctcttcatccccagttccttggcttttacctctttctggcttttgctcccttccccctactcctgtccttcctctttttcgcattataaccccctactttcttcctctcaccttgtaagctttttttctaggccccccattttttttcttaaaaaaaaaagggaaacaaaaaccctattgctacaaatgagaattttgagggtaactcttcgctagagccagagaccttttaaaggaatgcatcggtgtgcaggaatcgtggtggtgaggagactgaggtcctcagtatctgggaaatcttattgaggggaccctgtttcggtcatgtcacttgtgtcttcagtttggagatcctgaggttgtctgaagcgagtggatctatttttctaagtccaatagacgaccgcagtgagacacggtgcggggacggccaccgattactgaatgggaattgtgttatcatttgctaaatatattgtgacatacttcgtgcctcggtgaacagctcccttgaccttgtgcggctcctcctccctcgctctctgtccccctctggaatttcccctgagagatcaccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaa

SEQ ID NO: 3259 - DNA, 7782 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaagacaggacggagtccagtgtgagaatggctataactttggaagaagctccgtggctgggctggctcttggtgaaagcactgatgaggtttgccttcatggtcgtcaacaacctggttgctattccatcctacatctgctatgtaattatacttcagccccttcgagtgctggacagtaagcggttctggtatatcgaaggaatcatgtataaatggcttttaggaatggtagcttcctggggatggtatgctggatatacagtgatggaatggggagaagatattaaagcagtttcaaaagatgaagcagtgatgttggtgaatcatcaggcaacaggagatgtgtgcacactgatgatgtgcctccaggacaaaggactggttgttgctcagatgatgtggttgatggatcatatttttaagtacacaaactttggaattgtttctctagttcatggagacttctttataagacagggaagatcttatcgtgaccaacagctgctgcttctcaagaagcacttagaaaataattacaggagcagagatcgaaaatggattgttttgtttccagaagggggcttcctcaggaagaggcgagaaacaagtcaggcatttgccaagaaaaataacttgccatttcttacaaatgttactctgccaaggtctggggcaacaaaaattattttgaatgcacttgtagcacaacagaaaaatggaagtccagcaggaggagatgctaaagaattagacagcaaatcaaaaggcctccagtggataatagatacaacgatagcttatcccaaagctgaacctatagatattcaaacctggatccttggatacaggaaaccaacagtcacacatgtacattacaggatctttccaattaaagatgtacccctggagactgatgaccttaccacttggctctatcagcggtttgttgaaaaagaagacctcttatcacatttttatgaaacaggagcttttccaccttccaagggccataaggaagctgtttccagggagatgaccctcagcaacttgtggatatttctcatacagtcttttgcatttttgtcaggctatatgtggtacaacatcattcagtatttttaccattgcctgttttaggaattgacgtggacttgtcaaggtcaccgtaggagttcagactttctttcataagtgtgcattattttacatgtgcaaatcagaatatatttaaaaaaaagcaaaagaaattcaatggatggattaatatttatccccctttgggatattttaaaatctactaaaatgaggattagtaatataatgacctgctaatatattttaagaacatgttttaaaaagatacactctatcacatatttaagcaaacatcacatttggagaagaggaaatcataaaatcatcctagaagactatctgagagaaattctgttgccaccagttatacttgacaatttagttgaagctcagaaagttatattcatccctcttagctgtagtctatattagggcagttctctagaacgcccacatttccaccaactcagtaaacttgaggggagctggttggcacctcgtgaagaactctttccctgtcgtttgcagtaacaaactccagtctgttgcagtaacaaactccagtctgttgcagtaacaaactctagaatattgacattctctgtgggggaaaagcagtgtccactggaccccttctggtactggatgtgttctttacaaaggctagctcagtccaacactgtgtttacatacactcgtgcttttccttatctgacttctcattttgtatcagaggcatatcataaattgataattttgcaaaatgcacttttttgagatgcagatatagcaaaggattagtaatatagcctgaaaacaaatgggagcatagcagtgtgtgaggttctcgagaactgtcttgtctctgtgtgtttatttgcctgccagtgctctccagcgccatcctgccctggacaccaccctgacgtgatgcctctattgcagctcagaggctttattttttccattttgacattggcactaaatgcatttggggatggttaaaacaaattactatagaacatttaaatgatcagtttaaggggaaataggctagtttatagaaaaataagagctagtggcttataatggtgacaggttctcatgtggcacccctaggacctgtgcagacagtagtctgttgaatcattacatcaaggagctgcccctgtcagggtgagtgtaattaggaacgataccagcacataaggctccccccaatctcttccagttgctttttcttttttcttttttttttagacaggtcttactctgtcacccaggctgtagtgcagtggcataatctcagctcactgcagtctctgcctcccgggttcgagcgattctcctgcctcagcctcccgagtagctgggactacaggcacccaccatcatgcttggctaatttttgtatttttagtagagatggggtttcaccatgttggccaggctggcctcgaactcctgacctcaggtgatctgcccacctcggcttcctaaagtgctgggattgcaggcgtgagccaccacgcccggcctccagttgcttttgaagagggtaaagtcaagtttctatttctagaaaacattttttagaaatttgttgcgatgtttgtacaatttacctcataagagaaccacacccttctccaaaagtgctggtactgcatcagtgagatgagtagggtttttgtttgggattgtaagactattaagatcctagtaagtcagtggtagtttactgtgatgtgagcattgtagattcccccgttgtcactaatcacacaacaattttgagaagtaggctataaaacaaaaaaaggttgctgttttctatttttaaataaaccaaaaaaaaacagaaaagatgtgaattttccccagttatgtgggaaaggtaaagcaacaccaaataaaagcccacagcagcttcatctttacgataactcagtgcatatgtgaaagagaatgatgcattaactgaaatacctcattgaatattatactactactggtaaaatgcagaagacagtgttaatgtgtttggtttggggactggttgttataaaatgcaatttttttttaaatctaagcatttcattatgtgttctacagtgtcggtgaataaatgaaaccaatctcaatttagaggtatggatgatgacagaaagcccaatagaagcttaatgatgcttctgtttgaggcccagcaagcaccactaaattactggatgaaatgaaattgttcacttgagggattagtcaaccatctgggggagaagttgctcactgtcaaatacagcatgcacggtcctagctgatagaccttttcctcattgctacagcaagccacagggtagagtgaccagttctcctatccaaaaataaatgcgaacatgcatacataaatgtggctgagggccacttttgccatcactgtgctccaaaggaacatgatattgttaaatatactgtacacattaaactattctataagatgctttacttttcaagtacggtgtcattttcacagtctccagggtgacaaatgccaatagatatgtgagttaatttttttaaatatctccgtgagttgtaaatagatgtgtatttgatctgccctatccttctttgattctttaacatgttctctctcttctgtttgcaaaatatgtttgaaagcattggtagtgctttccttatcagtaactggagttctcctgcttgcactagagaaggtaaagagagaatcagtattcttatatggcaatctggggaagcagcaatatgccactgtacaaaactgaagaaaagttcctaatttgtactttgtgaagggagatgaaaggacgtttaaagtatatatattttgtcaagaggaaagaagataaaactatgccagttttatatcaatagcttgtagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctggatagataatctggtaataaatgataggtaaatcaaaaattacttttatttaggagtttgaattcttactctcatcagacattttttttctagggacgcttactaattaaatgatttaagttgtttcttaggggttttttgcctatatatttatgactgtgttaatgagtagtgaaatgatgcggaaagacagctatcaggaagaggaaatacagaagcctgaataatctatgggttagaaaagcatccctgaataatcaaaaattggcagtattggcattgttctcaagcctttttatgaaaatgaaatctgaaatcaccaaatgtaaacctgggaacattattctagtgttgctgtcttggattcatgttaagaagcgtcttcattctttgctcatgttgcccacttcttgtggatttgtctgagtgttttttgacaatcacttccttaaagactcttctgaactagttggacctggttaatcatagagagtagcctttaatcatggatagtcttcttggattatttttatatttgaaaagaaaatgttttatttgcactactgagtaggaagagttaattgttttctttgttctttttttgaagtcattacacaggacttcactccagagttaccattatgagtgtgttcagctctggtccacagaggatggataaaaatggtttgttatgtttttttgctctgcagtgctatgagccttatatctgttaatatgaaggacaaagtcaaaagcagcagtggatagcaggaagggtagagactaatatgtttgggaccaaaaccatctaagttagagatttccagatcacagaggggctgggcattctctggagcagtcattggttggtgctttattgtaatcattttgcgccaatccccaacaattaggaactggaccctgggaataagctgagggtgctgaactgttggggaagggtgactgtagccacatggaagataaaatatgggtttttctgcaaaatttccatctgagggtttttacatttaatatttttttaagacagtttaaagagcaaacgttttttaagtgtattctagttgcaaagtatgcacacatatcttgaatggctttatttttattgtgtaaaactgttgaacacatgactgtgatgcacaaattctttacgtgtaaggagtctatgcattttacagtaacttattttatgatcgggtgatgagacagttatactttcaactgccattatttttattaagtgctttcattttctttacagttattataaaattgtatttattttatacagatgggttttcattttcctgatgctgtaatgtttacttcagcttgttgacctttctttgtgttatctgcatgttgtaacgtgtgataagaatgaatgtaaaggctgtggcaactgtaattaatttttgtaaagggctggtcacacgtggatctggtttatgaatgcatttgggatgattttggtaaccagatcaccttttcagaaatttagatgtgaacaccaaaagaagcattttctcaacaaaaattaatagctggttctattttttttaaacctagaaaaaataaagttgatttttttcaattaaagtgcttttaattcttagcagtggggatggggcatgtgtgttttaccagagctatttgggcattaatatctgcaggcaagtacttaaagcacactgtggcagttggatgctgaaggcaaactgaaaaaccaaatgaaaaaacatcagacttccttctttggtttaaaaatatttccccctttctccccattctcccaatccagtggtgtgctggtaaatgtttagcagttcactcttctgggagaaaattatgtattcaactatacatgtttgttataaattttgctgatagcaagaacatataacacaattaacaaataataagatacaaatactttattgtaaatcccatatagccagttgattctcacagtatacttagttgctcaggaaagaactaaaatgcttttttaaaaggatacttaattgctttttgctcaactcctacagtcaacctatgattgattgtctttcaactgtgatttgaaaaatggcagactgtccaaatctaactcatttcccaataaatttattatcattcaatctgatacgtgatctactgttaaaactgtttcttaccatggtacatattagactcattaagccgaaaccacttttagctttaacattaattgtaaatttatatgattcaattttcataaccaatgcttaacaactgcaggcaaaattctaaaatgtgaccactgggtcttgggaatcagtaggggctgtatccagcacaccactgccccatcctttttttcttaactattagtgttgaataaacttctcatagttaatctacttgctgaactcaggaaattcctatcactgaccctggccagggctttaaagggtaggaaaagcattaatgtcagtcctacacagcgaacttttgatttagaagaatgtgacagaaagaaaacatttactgaaatacatgggaagcttgcatatttctaaagttgtctttatacttttcatttctcaaagctaagtaaactgtggtataggcatctctaagatgttagcatttaaaacatcaattgttttattgatgtttaaacaattgtttaaatcccactgaaaaatttaaatattaaaatatcttgcacagtctaccaaatgagttaaatcgttacagtcgtgtctacctcttatttttctatctgtatttaggctgctgttttggtgagattctaatttctttttcccctggaactactttctgtggaagacaaggaacagactggggacagaggcctgaaaacaaattggaagcactcagagatctattgctgaccagccctattcctcatgagttggcggggggaaagccattgtttttaatttccacttaatatgaaaatgcttgtttttaaaatgttttttcctgctgaacaaatgtatttttaaaaggaaaaaaattctcttttggctctaagaagtcagctgtatgagcaggcgtgaccatatcataacatgctgatatgatagaaatcaataaatttttacctctcagga

SEQ ID NO: 3260 - DNA, 1765 bp, Homo sapiens
atccagtacgtggcacacattgctcagaaaagccccttgtgcccgctttctgccatccgcgctgtctcgtgtctccctttttccattaaatgcctcttttcttgcgggtctcatctcgggaatagtgcactacggggacatacctatccccaactatcctaggcccgagaaccagcccttgccttcgcgtaacaggcggagactcgctgaggcgagttgcacttctaattgggcgtgaggtcttgtcaatccccaagttcttccaatcagaagtccggtccatccagccttccgctccccattggcctgtgtggaggaagaggggtgggtaagccgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgatggtgtccatgagtttcaagcggaaccgcagtgaccggttctacagcacccggtgctgcggctgttgccatgtccgcaccgggacgatcatcctggggacctggtacatggtagtaaacctattgatggcaattttgctgactgtggaagtgactcatccaaactccatgccagctgtcaacattcagtatgaagtcatcggtaattactattcgtctgagagaatggctgataatgcctgtgttctttttgccgtctctgttcttatgtttataatcagttcaatgctggtttatggagcaatttcttatcaagtgggttggctgattccattcttctgttaccgactttttgacttcgtcctcagttgcctggttgctattagttctctcacctatttgccaagaatcaaagaatatctggatcaactacctgattttccctacaaagatgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaacactaaggagctttttgacatctgttaaacgtctttttgtttttttgttaagtcttttacattttaatagtttttgaagacaatctaggttaagcaagagcaaagtgccattgtttgcctttaattggggggtgggaagggaaagagggtacttgccacatagtttcctttttaactgcactttctttatataatcgtttgcattttgttacttgctaccctgagtactttcaggaagactgacttaaatattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatactta

SEQ ID NO: 3261 - DNA, 3375 bp, Homo sapiens
accacgcgcgtgcggtaaacggtcccagaggcccgggccccggcggctgcgccgagtccccgcccctccctgctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacaatttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaga

SEQ ID NO: 3262 - DNA, 835 bp, Homo sapiens
ggagtcggcagcgcgagctcccagccagacctagcgcctctgggctgtgctcctgttgcttcccgcaaaccgcggtcctggcgaggcctgggcgtggagcgcggctgccgcagactccctgggaagacatggagtcagggtgcttaggggtttttaggctcctgctcgcctagtggctggctttctcccggctgagaagcgtctctgggttcccagaaaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcgactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcaca

SEQ ID NO: 3263 - DNA, 2039 bp, Homo sapiens
tgcgttttcagaagacagtactccagtgataaggtatctacaccacttaataactgtacctggtaaggagatttaataaggctgagggtggtattaagtttctcagaacagactcatctttgcggatgcagttgcagaacaggaaacagacccagggagaagtttagtccccccagatctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 3264 - DNA, 1644 bp, Homo sapiens
gtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 3265 - DNA, 1205 bp, Homo sapiens
gagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatcctttctgaagggcctgagtgacaagcagcgggaggaacattacttctgcaaggactttgtcaggctgaagaagatcccgacatggaaggagatggcgaaaggggtggctgtgaaggtggaggagcccaggtataaaaaggacaagcagctcaatgagaaaatctccctgctccgcagcgacatcaccaagctggaggtggacgccatcgtcaacgccgccaacagctccctgctcggaggcggtggcgtggacggctgcattcatcgggccgccggccccctgcttaccgacgagtgccggaccctgcagagctgtaagactggcaaggccaagatcaccggcggctatcggctcccggccaagtacgtcatccacacagtggggcccatcgcctacggggagcccagcgccagtcaggctgccgagctccgcagctgctacctgagcagtctggacctgctgctggagcaccggctccgctcggtggcgttcccctgcatctccaccggcgtgtttggctacccctgtgaggcggccgccgagatcgtgctggccacgctgcgagagtggctggagcagcacaaggacaaggtggaccggctgatcatctgcgtgttcctcgagaaggacgaggacatctaccggagccggctcccccactacttccccgtggcctgaggctcccgcagcccaccctgaccgggactgacccgccttcgggaccccgctcccagctctgagaggtcgccaaagcctgcagcctggcctgggcctggccaccccttctttccctccgcgccccgcccccgaggagcctaataaagatctcgttgtggca

SEQ ID NO: 3266 - DNA, 4442 bp, Homo sapiens
atctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaactgctgtgaagcgctattatacattcaacacctaccctggctgcacagatctcaattctcccaacttcaattttcaggccaacacggatgatggctcctgcgaggggaaaatgaccaacttctctttcggtggggtttatcaggaatgcactcagctctcagggaatagggatgtcctcctctgccaaaagttggagcagaagaatccactcactggtgatttctcctgcccctctggctactccccggtgcacctgttatcccagatccacgaggagggttacaaccacctggagtgtcatcgaaagtgcactctcctcgtcttctgcaagaccgtgtgtgaagatgtgttccaggtggcaaaagctgaatttagggctttttggtgtgtggccagcagccaagtacctgaaaactcaggactgctttttgggggcctcttcagcagcaagagcataaaccccatgacaaatgcacagtcatgcccagccggctactttccactgagactctttgaaaacctcaaggtatgtgtttctcaggactatgagttgggaagcaggtttgcggtcccctttggcgggttctttagctgcacagttgggaaccccctggtagatcctgctatatccagagatttaggggcaccgtctctgaaaaagtgccccgggggcttcagccagcacccagccctcatcagcgatggatgccaagtgtcctattgcgtcaaatccgggctcttcacaggagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaacctgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactcttggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttatatgaacacacacacacacacacacacacacacacacacacacgcacacacataccacatttcaataagtcttcattgttctgggtccttacctttcctgtcctcctgttatatgaacacacacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaactacttttttttccagcagaaagggagctgacatgatcaaatccatgttttcaaatgaactgaaaaaggcatccagcaccacttataacacatttatttcagttccaggctgacagccctggggcatctagcaggatgcataattgtcatctggtgagagttgggactttgctcaattttaataccaatctctcctgattgtaattacctccactactttcatgatccccctacaatatttttttaaatgatatatttattcactgaatcaaatgtcattaatgagttatcttctgtggaggatgactgttctctttgttaatgttcacaatcaagatcttgggctgagaagaggcccttcacccaaggagtttgaagtatcacagtgtgtgggaaggtgggaaccaggatacccattcatttccaaccgagacacagagaagtgagtcacagaatttgagcccgctctcttgactgcccagccagagacactgatttctgtaacctcttcacttgatcctgcctcttaagcattaaaacattctcctaaacctctgagtgttttgtgggttctgggtgttttgtacattttagccaagctaaccacttgtctgcaagtactgactttcctatgaattctttgaagattattgagtcagaaaggaaaaatatagccccaaattcccaggcttttaatgcattacattaactgcctattgaaatgagaagttcttcacaaacttgtatacccactaacaagattgcacataaacatgcattaaagtatatactaagaaaccctctgtccaacggctcatgcatatgaagtccgaacatgggagtttgccaattgcattcatcaagtcgttttgcggagtcagatccctgatggaagagctcacaggctctgccttccaagtcctgggttcctaactggtgaccttagcctggggtctgtggggagaccaaccctggcttccaagaaaaccacattccatggactatcagaaatagacacagatttgggtgacaaagctggctctgtatttgcattttatttttgtgttcttgtcagtttgggaatgattaatattaaacatttatttgagaaacaa

SEQ ID NO: 3267 - DNA, 1009 bp, Homo sapiens
agagaactcatgagttttccgcttcatcatctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagta

SEQ ID NO: 3268 - DNA, 2361 bp, Homo sapiens
agtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagt

SEQ ID NO: 3269 - DNA, 805 bp, Homo sapiens
gtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaag

SEQ ID NO: 3270 - DNA, 2244 bp, Homo sapiens
agtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttgctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagt

SEQ ID NO: 3271 - DNA, 2423 bp, Homo sapiens
agtgcagtaattggtggaaagctggaagtgggcacctcgagggcctcagccccacgaacacagtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtataacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 3272 - DNA, 2173 bp, Homo sapiens
ggacgcacgcgggatggcggagtgggaggcgcgcggggttgggggtgctcctgcgtccggtgtgcaccccatggcccccgccagggagaccgagtccgggccaggggccggaatcgcggggcgcgggccggggctggggttggggttgggatcgggatcgggatcgggatcgggatccgggttccccgcggcttcaagttttctctcgctgttacgagggcgtgggaggcgcggccgtggggtggggtggggccaggtccgcgatgtgctcaccctggtctctcaggaccgttgcctttgcggctattttttgtgcaatccccgaagcctgcgtttcctgctgcctgggttcggggcgggggcatcgcgcaggccagaacggcccctgcgtccgtaggccagagcccctgccatcagcccctttagggtgctcgccggctgtcgggtgtgggggtatgccaggccccggaggactcggcttccccgctaacccgacccgccgcaccccacccaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgtttt

SEQ ID NO: 3273 - DNA, 1753 bp, Homo sapiens
gccgggcgtggccgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttata

SEQ ID NO: 3274 - DNA, 2506 bp, Homo sapiens
cccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatgcctgtaatcccaacactttgggaggctgaggtgggtggatcacctgaggtcaggagtttgagaccagcctggccaacatggtgaaacctcatctctactaaaaatacaaaaatgtgttgggtttggtggtgcatgcctgtaatcctagctactagggaggctgaggtaagagaattcgcttgaacctgggaggcggaggttgcagtgagccgagatcgtgccattgcactccagcctggatgacaagagtgaaactccatctc

SEQ ID NO: 3275 - DNA, 2350 bp, Homo sapiens
cccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcattttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgccatgtaataatgggaagcatatgtcattccccatatgtgttggagaatgacatttaaataaatagcaaagctgggtgtggtgttgcaccgctatactcccagctgttggggaggctgagacagaaggatcacttcagcccaggagattgaggctgcggtgagctatgatcacaccactgcactccaggctgggcaacagagtgagaccctgtcttgaaaataataataggctggtcacagtggctcatgcctgtaatcccaacactttgggaggctgaggtgggtggatcacctgaggtcaggagtttgagaccagcctggccaacatggtgaaacctcatctctactaaaaatacaaaaatgtgttgggtttggtggtgcatgcctgtaatcctagctactagggaggctgaggtaagagaattcgcttgaacctgggaggcggaggttgcagtgagccgagatcgtgccattgcactccagcctggatgacaagagtgaaactccatctc

SEQ ID NO: 3276 - DNA, 2123 bp, Homo sapiens
tggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctgactcctgacagcctcctgcacctgtgcaagggaactgtggggacgcacgaggatgccccccagggccttggggaaaagcccccactgcccctcactcttctctggacccccaccctccatcctcacccagctcccgggggtggggtcgggtgagggcagcagggatgcccgccagggacttgcaaggaccccctgggttttgagggtgtcccattctcaactctaatccatcccagccctctggaggatttggggtgcccctctcggcagggaacaggaagtaggaatcccagaagggtctgggggaaccctaaccctgagctcagtccagttcacccctcacctccagcctgggggtctccagacactgccagggccccctcaggacggctggagcctggaggagacagccacggggtggtgggctgggcctggaccccaccgtggtgggcagcagggctgcccggcaggcttggtggactctgctggcagcaaataaagagatgacggc

SEQ ID NO: 3277 - DNA, 2082 bp, Homo sapiens
tggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaacccaa

SEQ ID NO: 3278 - DNA, 2284 bp, Homo sapiens
tggggcggacgcggcggacgtgggtgagggcgcggccgtaagagagcgggacgcggggtgcccggcgcgtggtgggggtccccggcgcctgcccccacggcacccaagaaggcctggccagggtaccctccgcggagcccgggggtggggggcgcgggcccggcgccgcgatgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactaggccaggatgagacctgcacgcagtggctcacagcagcacgatttgtgacagcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtattttaccacaataaacaaaacaaaacaaaaccaaaccaaacccaa

SEQ ID NO: 3279 - DNA, 1521 bp, Homo sapiens
agcatgccgggagccgccggccgccggtgtccggaccgctcgcccccgtttggacccgacttcggttcttctggggtgttgatgctcctaaagcccgagagcacgtgtccagaccctagcctgtacgacgctgactctgcccggtcccagaaccaaagccatgccggggtgtggcctctgaccccacgcggaggggacctcgccttgcgggaccccacctggaacccgacctcccagcctcgcagccggcctgagccgccatgcgcgggaagttgctgccgctggccggcctctacctggtgcagggcctgccctacgggctccagtccggcctcctgccagtgctgctgcgtgccggcggcctctcgctgacgcgcgtggggctggccaaggttctgtacgctccgtggctgctcaagctggcttgggccccgctggtggacgcgcagggctcggcgagggcctgggtgacgcgcagcacggcgggcctgggcctggtgtgtgggctgcttgccgggctgccccctcctggagctggccaggccgggctgcccgccgctgtggcggggttgctgctgttgttgaacctgggtgccgccatgcaggatgtggccctggacgcgctggctgtgcagctgctggagccggccgaactggggccgggcaataccgtgcaggtggtcgcgtacaagctgggggccgcgctagctgggggcgcgctgctggcgctgctgcccaccttctcgtggccgcaactctttctgctcctggctgccacctactggctggccgcggccctggcctgggctgcaccagccctgcggcggctcccacagcagcccccttccgagcagcgtccccacaccgcgcaccttctgcgggacgtgctagccgtgccggggaccgtgtggacggcaggctttgtgctcacctacaagctgggtgagcagggtgccagcagcctgtttcctcttctcctgctggaccacggcgtttctgctcccgagttgggactgtggaatggtgtgggtgctgtggtctgctccatcgctggctcctccctgggtgggaccttgctggccaagcactggaaactgctgcctctgttgaggtcggtgctgcgcttccgcctcgggggcctagcctgtcagactgccttggtcttccacctggacaccctgggggccagcatggacgctggcacaatcttgagagggtcagccttgctgagcctatgtctgcagcacttcttgggaggcctggtcaccacagtcaccttcactgggatgatgcgctgcagccagctggcccccagggccctgcaggccacacactacagccttctggccacgctggagctgctggggaagctgctgctgggcactctggccggaggcctggctgatgggttggggccacatccctgcttcttgctcctgctcatcctctctgcctttcccgttctgtacctggacctagcacccagcacctttctctgagctgagtggctggagtggtcaa

SEQ ID NO: 3280 - DNA, 4095 bp, Homo sapiens
cgcgggcctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtttgagatcattcttcattgaagtttgtaaaaataggttgaaattgtaaagctccatgatcattgctatatgtagatatatttcaatttaagcaaaacaagctgcaagttattccctggcatgctcaaaggattttcgtgcttttcacttaatagtccaaagtctcttaaattcctgctgcagacatcaatagcttatctatattctcaaacaccaaaaggaaaagttgaatcttgctctctttggtatactaatgtagtggtatgctaagctggctcataccaacttagaaaagctgattgtaaaattttcattttgacagctggttattaaatgcagccattattaaaaatcaaatcatacaaacttataattaaatcaattacatttaaaacaaaggtaataaatattcaaagcatatcacttcctaatttgatcttgatgctcttgaggtaatttacgtccatggtacctgtgtggtggaattactatatatgatggtgtgctactgtgcaccttgtctcaactccactcttcgtgatagcatgttggtagcttgaaatcagcctggtgggagtattaccatggacactggcaaaagctacagatcccggagagccagtggttaaacatttaccagcataccactgctagtaatcaaggctaactggtccagaaatcgcccaggagaatgaaatggatgttccatttttttctactgacattgactagcatataaaaggtatagaaacagcactaagactttctgaaaatacctaatgaaaattttacatctttttttgtttttgtttttgtttttgagacagagtctcactctgttgccaggctggaatgcagtggcgtcatctcggctcactgcaacctccgcctcccagtttcaagcgattctcctgcctcagcctcccaagtagctgtgactacaggcgcatgccatcacgcacagctaattttttgtatttttagtagagacgggatttcaccgtgttagccaggatggtcttgatctcctgacctcatgatctgcccgtctcggcctcccaaagtgctgggattacaggcgtgagccactgcacccagccaaaaattttacatcttttatagagggaaaaaaactctttataccatggcaaggccttttctttcacaaaaagctgggcctactgaacaattcaagctgtgcagtagtagactgaaagcaggatttgttgaggagttacagctcctgtccagagcaaatcctgtagtgatacaaggagaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctggtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacctaccctacctcaaaggaattctgaaaaaagtaagtgaatttgtataaagcaaagcactcacaatatgcctgacacacaaactgcttaataaatgttagtaatttttaaaacctcctcataagcggcttagaaattattcatgtttggtacatatttattgcaagtcaagcagatccaacttttttgaaagctggtggtctaggagtatagttttaattatatttgtaaatactcaaaagtattagatgccagtctaatttaaatgcagtctgactgtagcgagtaactgacctgggcaatgaaaaagcagttgtatttttcttgtggtttttcaagaaaatatcctttttatacagatttagaaagaagaatcaatggctatatcgaagttgattgtgactaatttgttaatacagaaaacaacattaacacaaatctaagagtacctttcctaaaataaaatatttaaactta

SEQ ID NO: 3281 - DNA, 1320 bp, Homo sapiens
gtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccagcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaaggctgtgcaaccacagtgctggtgacaggggcaggagttggcgagatggtgctgcagatgctggttggttcgatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagaga

SEQ ID NO: 3282 - DNA, 1883 bp, Homo sapiens
ctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtcttcttctcgcagcagctctgcctcctgctgggcagcgccctcgggggcgtcttcaaaaggaccctggcccagtcactatgggccctgttcacctcctctctggccatctccctggtgtttgccgtcatccccttctgccgcgacgtgaaggtgctggcctcagtcatggcgctggcgggcttggccatgggctgcatcgacaccgtggccaacatgcagctggtaaggatgtaccagaaggactcggccgtcttcctccaggtgctccatttcttcgtgggctttggtgctctgctgagcccccttattgctgaccctttcctgtctgaggccaactgcttgcctgccaatagcacggccaacaccacctcccgaggccacctgttccatgtctccagggtgctgggccagcaccacgtagatgccaagccttggtccaaccagacgttcccagggctgactccaaaggacggggcagggacccgagtgtcctatgccttctggatcatggccctcatcaatcttccagtgcccatggctgtgctgatgctgctgtccaaggagcggctgctgacctgctgtccccagaggaggcccctgcttctgtctgctgatgagcttgccttggagacacagcctcctgagaaggaagatgcctcctcactgcccccaaagtttcagtcacacctagggcatgaggacctgttcagctgctgccaaaggaagaacctcagaggagccccttattccttctttgccatccacatcacgggcgccctggtactgttcatgacggatgggttgacgggtgcctattccgccttcgtgtacagctatgctgtggagaagcccctgtctgtgggacacaaggtggctggctacctccccagcctcttctggggcttcatcacactgggccggctcctctccattcccatatcctcaagaatgaagccggccaccatggttttcatcaacgtggttggcgtggtggtgacgttcctggtgctgcttattttctcctacaacgtcgtcttcctgttcgtggggacggcaagcctgggcctgtttctcagcagcaccttccccagcatgctggcctacacggaggactcgctgcagtacaaagatattccaggctcagggcagctatagtttcctggtctgtggcgtgatctttggttgtctggcttttaccttctatatcttgctcctgtttttccacaggatgcaccctggactcccatcagttcctacccaagacagatcaattggaatggaaaactctgagtgctaccagaggtaaaactgggtgaagaaggcaagagaagactttcagcctcttgatcaccagcacgaccatactgtttcagaaagctgggtggtggtggaggcgctctctcaatggctattcaagtcttctccactaaaacttggttgggtagaggaaattaaattgagtcctggtacctggtcaaaatcattagaagtttacctggcttctcaagttatcttcttccctggttcagactgttggtaagagctgtccagatacccagatgggaaggaaggagacagccgcgcgcttcactccatttgtcacctcatgcatggaccatactctgggtt

SEQ ID NO: 3283 - DNA, 1379 bp, Homo sapiens
agtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggacagtgatcgaaaaacaggcactcggaatatgttcagcatttgctctgctgtcatggtga

SEQ ID NO: 3284 - DNA, 1760 bp, Homo sapiens
cgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgat

SEQ ID NO: 3285 - DNA, 2038 bp, Homo sapiens
actgggaagttatgcggcttgcccaaggccacacagctggtaagtgacaggggcaggactgcgccttagtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatc

SEQ ID NO: 3286 - DNA, 1759 bp, Homo sapiens
actgggaagttatgcggcttgcccaaggccacacagctggtaagtgacaggggcaggactgcgccttagtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatc

SEQ ID NO: 3287 - DNA, 2232 bp, Homo sapiens
cgcctctccctccgggcggggcccctttcggtccaacggcaggacctgggggctgtggccgggggcggccgttgacctggtgaccgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatgagtgccaacccccggtgggacatcagcagggcgctgggggtggccaagctcttccacctggtgtgcggggtgcgggaagcctgcgtgaccccgttcctgaccctttacctgaggcagctgggcttggccgcgccctgggtgggcaccctaatgggaaccaagcacctaatcgctgccttctgggctcccgtctgtgccttcctggccaaaagctaccggaaaaggagagcgcttctgatcggctccctgctcggctcggtgggggccagcctgctgatggtcctggtcccaccggtagacaaaaatcgggtgcacttcccttgtaatggaagcagcggcctgaccagcacagacgcactcccgggggtcacgctacctgtgaacatcacctcggcccaagagtctgcctccagccacccagccaagaggactgcagaggtggaaatgcctggcttcagaaacccacctggtgaaagtgaccgagaaactttccgtgatctgcacgtctacttagcgccctccgttgaaggagctaggaccacatcccaagctctcctccatcctgtcacttcggggctgaaagatcatccctgggaagttacttttgaggtggtcaagacagccctccccttgcttcctggggggaaagggcccgggaatccagccaatttgtcagggaccaaggggaaagcctgggcttttgacctgtccttggaggcgttgcggcggacttttatcctctccttggggtccgtggcgttctgggagctgctgacagcgcctctggagcaggtggcagatgacagcctttatgagttcctggattttgtggatgccactgaccgatacagaagcctgtgggtctggaggttgctgggcatgtcggcaggcgtgtgtggcatcacagccttggtggggcagctggactgcttcctgatgaccagtggcccccgaggtgtggtccacttctatgggtactcggtggtcagcaccctggccttactggtgagcattgcctttcccattcccatctgtcagcagtgggagcccagctacaaaagggtcaaagcactgtccattgtggggggtgacccccacctcattctcctcgcctccaccactgttttggtaggagccatcgtcagtactgtccagaactttctgttctggcacatgaaggaccatgggagcggcgagctggtcatgggtttctcggtcgccctcagcttgctgggggaaattctgcttcatccgttcaaagctacattgcttaggaaactgtccaggacgggcctggtggggctggggctgagctgcctcgctgggcagctgctgtactactctttcctctggagctggtggtccgtcctccccattcagatcttgagtgccattagcaacagagctttgtggtgggctgtgggggcctcagtagaggacctggccactccccgcatggagagggctctgagtgccttgttccgaggccacttttacgggagtggctgtagcctgggcagctttgtcgggggcttcgtggtgatgcgcttcagcctggctgtgctctaccaggcctgctgtgtggccctgttgctctggttggccttgctcctgtccatacagcggaggctgccccgagagcggaaaatcaagtactcgaagctgctgtccatggaggtgagtgacaccagtgactctgagcaggggacagaacaggactggcttgtgaaggccatgagggaggaacactcagactgaaagggctgagaaatccagagtgtgctgatccagcaaggaacgaatggactgaacaaaactcagcctgctgaggacagaaacctgccctggactgctgggagccggggaagagaggatgggtctgtgctgaaggcccaacaggatcatctcattgcatgattttctttacttttgaagtaaaaggagatttaactttttgccaatcttttttagataatggaggaagaatacatttgcttttt

SEQ ID NO: 3288 - DNA, 2123 bp, Homo sapiens
ctgagaagcacacaggctgtgaccggggcccttcccggaagggacattcggtttttgtggcagggacttccagcctgaggccgaaggaggagggtccaacttcacctttgcccgcccttcccccgcttttttgggtctcctttaactgggacggggcgggaccctcctccgtagtccttggggcggaactggccccccgtggcccggcccggcccggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgca

SEQ ID NO: 3289 - DNA, 1599 bp, Homo sapiens
gtagtccttggggcggaactggccccccgtggcccggcccggcccggccccacctccgcccgcaggcggtcccggcccacgcgggaaggtccttaagcccgggcggccggcgggaccggcggagacccgtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgatcaactggctgtcactggtctacctcgtggtatccaccccatttggcgtggcggccatctggatcctggactccgtcgggctccgtgcggcgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctgca

SEQ ID NO: 3290 - DNA, 1826 bp, Homo sapiens
gtggaggccgccgacgatggcggggccgacggaggccgagacggggttggccgagccccgggccctgtgcgcgcagcggggccaccgcacctacgcgcgccgctgggtgttcctgctcgcgatcagcctgctcaactgctccaacgccacgctgtggctcagctttgcacctgtggctgacgtcattgctgaggacttggtcctgtccatggagcagatcaactggctgtcactggtctacctcgtggtatccaccccatttggcgtggcggccatctggatcctggactccgtcgggctccgtgcggcgaccatcctgggtgcgtggctgaactttgccgggagtgtgctacgcatggtgccctgcatggttgttgggacccaaaacccatttgccttcctcatgggtggccagagcctctgtgcccttgcccagagcctggtcatcttctctccagccaagctggctgccttgtggttcccagagcaccagcgagccacggccaacatgctcgccaccatgtcgaaccctctgggcgtccttgtggccaatgtgctgtcccctgtgctggtcaagaagggtgaggacattccgttaatgctcggtgtctataccatccctgctggcgtcgtctgcctgctgtccaccatctgcctgtgggagagtgtgccccccaccccgccctctgccggggctgccagctccacctcagagaagttcctggatgggctcaagctgcagctcatgtggaacaaggcctatgtcatcctggctgtgtgcttggggggaatgatcgggatctctgccagcttctcagccctcctggagcagatcctctgtgcaagcggccactccagtgggttttccggcctctgtggcgctctcttcatcacgtttgggatcctgggggcactggctctcggcccctatgtggaccggaccaagcacttcactgaggccaccaagattggcctgtgcctgttctctctggcctgcgtgccctttgccctggtgtcccagctgcagggacagacccttgccctggctgccacctgctcgctgctcgggctgtttggcttctcggtgggccccgtggccatggagttggcggtcgagtgttccttccccgtgggggagggggctgccacaggcatgatctttgtgctggggcaggccgagggaatactcatcatgctggcaatgacggcactgactgtgcgacgctcggagccgtccttgtccacctgccagcagggggaggatccacttgactggacagtgtctctgctgctgatggccggcctgtgcaccttcttcagctgcatcctggcggtcttcttccacaccccataccggcgcctgcaggccgagtctggggagcccccctccacccgtaacgccgtgggcggcgcagactcagggccgggtgtggaccgagggggagcaggaagggctggggtcctggggcccagcacggcgactccggagtgcacggcgaggggggcctcgctagaggaccccagagggcccgggagcccccacccagcctgccaccgagcgactccccgtgcgcaaggcccagcagccaccgacgcgccctcccgccccggcagactcgcaggcagggtccaagcgtccaggtttattgacccggctgggtctcactcctccttctcctccccgtgggtgatcacgtagctgagcgccttgtagtccaggttgcccgccacatcgatggaggcgaactggaacatctggtccacctgcgggcgggggcgaaagggctccttgcgggctccgggagcgaattacaagcgcgcacctg

SEQ ID NO: 3291 - DNA, 4049 bp, Homo sapiens
aggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgaca

SEQ ID NO: 3292 - DNA, 1074 bp, Homo sapiens
agattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggca

SEQ ID NO: 3293 - DNA, 1334 bp, Homo sapiens
cgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 3294 - DNA, 1854 bp, Homo sapiens
cgcttcgcacaggagcagaggggtcagggcgaagtcccagggccccaggcgtggctctcagagtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 3295 - DNA, 1548 bp, Homo sapiens
agattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcc

SEQ ID NO: 3296 - DNA, 1334 bp, Homo sapiens
cgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3297 - DNA, 1868 bp, Homo sapiens
aaggggagaggagggcctgaaggatgagaaggacggagggaagggctggagaagcaggaggcgcaactcttcccgattaaaaacaaaaacaacaacaacaaaaatctacacctccattcccagagcaagcttactctctggcaccaaactccatgggatgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3298 - DNA, 1854 bp, Homo sapiens
cgcttggcacaggagcagaggggtcagggcgaagtcccagggccccaggcgtggctctcagggtctcaggccccgaaggcggtatatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcaggtggggaagggatgaaggatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3299 - DNA, 1868 bp, Homo sapiens
aaggggagaggagggcctgaaggatgagaaggatggagggaagggctggagaagcaggaggcacaacttttccggattaaaaacaaaaacaacaacaacaaaaatctacacctccattcccagatcaagcttactctctggcaccaaactccatggggtgatttttcttctagaagagtccaggtggacagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaagacatgagaaccttccagagtcca

SEQ ID NO: 3300 - DNA, 1327 bp, Homo sapiens
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3301 - DNA, 1334 bp, Homo sapiens
cgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3302 - DNA, 1334 bp, Homo sapiens
cgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 3303 - DNA, 1854 bp, Homo sapiens
cgcttcgcacaggagcagaggggtcagggcgaagtcccagggccccaggcgtggctctcagggtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 3304 - DNA, 1865 bp, Homo sapiens
aaggggagaggagggcctgaaggatgagaaggatagagggaagggctggagaagcaggaggcacaacttttccggattaaaaacaaaaacaacaacaaaaatctacacctctattcccagagcaagcttactctctggcaccaaactccatggggtgatttttcttctagaagagtccaggtggacagggtccttcatcctggatactcacgacgcggacccagttctcactcccattgggtgtcgggtttccagagaagccaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcca

SEQ ID NO: 3305 - DNA, 1854 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcaggtggggaaggggtgaaggatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3306 - DNA, 1334 bp, Homo sapiens; identical to SEQ ID NO: 3302

SEQ ID NO: 3307 - DNA, 1865 bp, Homo sapiens; identical to SEQ ID NO: 3304

SEQ ID NO: 3308 - DNA, 1854 bp, Homo sapiens; identical to SEQ ID NO: 3303

SEQ ID NO: 3309 - DNA, 1334 bp, Homo sapiens
cgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3310 - DNA, 1525 bp, Homo sapiens
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3311 - DNA, 1334 bp, Homo sapiens
cgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3312 - DNA, 1868 bp, Homo sapiens
aaggggagaggagggcctgaaggatgagaaggatggagggaagggctggagaagcaggaggcgcaacttttcccgattaaaaacaaaaacaacaacaacaaaaatctacacctccattcccagagcaagcttactctctggcaccaaactccatggggtgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3313 - DNA, 1543 bp, Homo sapiens
ggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcaggtggggaaggggtgaaggatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3314 - DNA, 1868 bp, Homo sapiens
aaggggagaggagggcctgaaggatgagaaggatggagggaagggctggagaagcaggaggcgcaacttttcccgattaaaaacaaaaacaacaacaacaaaaatctacacctccattcccagagcaagcttactctctggcaccaaactccatggggtgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3315 - DNA, 1868 bp, Homo sapiens
aaggggacaggagggcctgaaggatgagaaggacggagggaagggctggagaagcaggaggcgcaactcttcccgattaaaaacaaaaacaacaacaacaaaaatctacacctccattcccagagcaagcttactctctggcaccaaactccatgggatgatttttcttctagaagagtccaggtggacagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3316 - DNA, 1856 bp, Homo sapiens
agcttggcacaggagcagaggggtcagggcgaagtcccagggccccaggcgtggctctcagggtctcaggccccgaaggcggtgtatggattggggagtcccagccttggggattccccaactccgcagtttcttttctccctctgccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcaggtggggtgaagggatgaaggatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaaccttccagagtcca

SEQ ID NO: 3317 - DNA, 1410 bp, Homo sapiens
ccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaattt

SEQ ID NO: 3318 - DNA, 506 bp, Homo sapiens
ccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggctcagatcaccaagcgcaagtgggaggcggtccatgcggcggagcagc

SEQ ID NO: 3319 - DNA, 1533 bp, Homo sapiens
agattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgag

SEQ ID NO: 3320 - DNA, 1533 bp, Homo sapiens
agattctccccagacgccgaggatggtgctcatggcgccccgaaccctcctcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgag

SEQ ID NO: 3321 - DNA, 1466 bp, Homo sapiens
ttctaaagtccgcacgcacccaccgggactcagattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtat

SEQ ID NO: 3322 - DNA, 1902 bp, Homo sapiens
agattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcaggtggggaagggatgaagggtgggtctgagatttcttgtctcactgagggttccaagacccaggtagaagtgtgccctgcctcgttactgggaagcaccatccacaattatgggcctacccagcctgggccctgtgtgccagcacttactcttttgtaaagcacctgttaaaatgaaggacagatttatcaccttgattacggcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctggctcctttctggtatctcacaggacattttcttcccacagatagaaaaggagggagctactctcaggctgcaagtaagtatgaaggaggctgatgcctgaggtccttgggatattgtgtttgggagcccgtgggggagctcacccaccccacaattcctcctctagccacatcttctgtgggatctgaccaggttctgtttttgtcctaccccaggcagtgacagtgcccagggctctgatatgtctctcacagcttgtaaaggtgagagcctggagggcctgatgtgtgttgggtgttgggcggaacagtggacgcagctgtgctatggggtttctttgcattggatgtattgagcatgcgatgggctgtttaaagtgtgactcctcactgtgacagatacgaatttgttcatgaatatttttttctatagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtat

SEQ ID NO: 3323 - DNA, 1548 bp, Homo sapiens
agattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaattaatggaacgcatgagaaccttccagagtcc

SEQ ID NO: 3324 - DNA, 1902 bp, Homo sapiens
agattctccccagacgccgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgaagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcaggtggggaagggatgaagggtgggtctgagatttcttgtctcactgagggttccaagacccaggtagaagtgtgccctgcctcgttactgggaagcaccatccacaattatgggcctacccagcctgggccctgtgtgccagcacttactcttttgtaaagcacctgttaaaatgaaggacagatttatcaccttgattacggcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctggctcctttctggtatctcacaggacattttcttcccacagatagaaaaggagggagctactctcaggctgcaagtaagtatgaaggaggctgatgcctgaggtccttgggatattgtgtttgggagcccgtgggggagctcacccaccccacaattcctcctctagccacatcttctgtgggatctgaccaggttctgtttttgtcctaccccaggcagtgacagtgcccagggctctgatatgtctctcacagcttgtaaaggtgagagcctggagggcctgatgtgtgttgggtgttgggcggaacagtggacgcagctgtgctatggggtttctttgcattggatgtattgagcatgcgatgggctgtttaaagtgtgactcctcactgtgacagatacgaatttgttcatgaatatttttttctatagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtat

SEQ ID NO: 3325 - DNA, 1466 bp, Homo sapiens
ttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctgtgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagtat

SEQ ID NO: 3326 - DNA, 1410 bp, Homo sapiens
ccgcacgcacccaccgggactcagattctccccagacgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagagcaccccacccccatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaattt

SEQ ID NO: 3327 - DNA, 1902 bp, Homo sapiens
agattctccccagacgccgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcaggtggggaagggatgaagggtgggtctgagatttcttgtctcactgagggttccaagacccaggtagaagtgtgccctgcctcgttactgggaagcaccatccacaattatgagcctacccagcctgggccctgtgtgccagcacttactcttttgtaaagcacctgttaaaatgaaggacagatttatcaccttgattacggcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctggctcctttctggtatctcacaggacattttcttcccacagatagaaaaggagggagctactctcaggctgcaagtaagtatgaaggaggctgatgcctgaggtccttgggatattgtgtttgggagcccgtgggggagctcacccaccccacaattcctcctctagccacatgttctgtgggatctgaccaggttctgtttttgtcctaccccaggcagtgacagtgcccagggctctgatatgtctctcacagcttgtaaaggtgagagcctggagggcctgatgtgtgttgggtgttgggcggaacagtggacgcagctgtgctatggggtttctttgcattggatgtattgagcatgcgatgggctgtttaaagtgtgactcctcactgtgacagatacgaatttgttcatgaatatttttttctatagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaactttttccttccctattaaaattagaacctgagtat

SEQ ID NO: 3328 - DNA, 506 bp, Homo sapiens; identical to SEQ ID NO: 3318

SEQ ID NO: 3329 - DNA, 1548 bp, Homo sapiens; identical to SEQ ID NO: 3323

SEQ ID NO: 3330 - DNA, 1416 bp, Homo sapiens
cgaggatggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctagttctctttggagctatgttcgctggagctgtggtcgctgctgtgaggtggaggaggaagagctcagatagaaaaggagggagctactctcaggctgcaagcagtgacagtgcccagggctctgatatgtctctcacagcttgtaaagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaccaccccacccccatgtccaccatgaccctcttcccacgctgacctgtgctccctccccaatcatctttcctgttccagagaggtggggctgaggtgtctccatctctgcctcaacttcatggtgcactgagctgtaacttcttccttccctattaaaattagaacctgagt

SEQ ID NO: 3331 - DNA, 1410 bp, Homo sapiens; identical to SEQ ID NO: 3326

SEQ ID NO: 3332 - DNA, 1561 bp, Homo sapiens
ccccacgcacccacccggactcagaatctcctcagacgccgagatgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagctcacccccgtgtccaccgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3333 - DNA, 1547 bp, Homo sapiens
ccggactcagagtctcctcagacgccgagatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3334 - DNA, 1154 bp, Homo sapiens
ggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3335 - DNA, 1154 bp, Homo sapiens
ggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggacattttcttcccacaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagctcacccccgtgtccaccgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3336 - DNA, 1589 bp, Homo sapiens
agtgtcgccggggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3337 - DNA, 1154 bp, Homo sapiens
ggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggacattttcttcccacaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttccagaa

SEQ ID NO: 3338 - DNA, 1605 bp, Homo sapiens
tctagagaagccaatcagcgtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3339 - DNA, 1008 bp, Homo sapiens
agatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgatcaggagcagaagtccctgttccccgctcagagactcgaactttccaatgaataggagattatcccagaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 3340 - DNA, 1406 bp, Homo sapiens
agagtctcctcagacgccgagatgctggtcatggcgccccgaaccgtcctcctgctgctctcggcggccctggccctgaccgagacctgggccggctcccactccatgaggtatttctacacctccgtgtcccggcccggccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcct

SEQ ID NO: 3341 - DNA, 820 bp, Homo sapiens
gccccgaaccctcctcctgctgctctggggggcagtggccctgaccgagacctgggccggtgagtgcggggtcgggagggaaatggcctctgtggggaggagagaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcg

SEQ ID NO: 3342 - DNA, 863 bp, Homo sapiens
cccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcacccccaggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcg

SEQ ID NO: 3343 - DNA, 1605 bp, Homo sapiens
tctagagaagccaatcagtgtcgccggggtcccagttctaaagtccccacgcacccacccggactcagaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3344 - DNA, 1154 bp, Homo sapiens
ggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3345 - DNA, 1154 bp, Homo sapiens
ggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcagggcattttcttcccacaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaa

SEQ ID NO: 3346 - DNA, 864 bp, Homo sapiens
cccggactcaaaatctcctcagacgccgagatgcgggtcacggcgccccgaaccgtcctcctgctgctctcgggagccctggccctgaccgagacctgggccggtgagtgcggggtcggcagggaaatggcctctgtggggaggagcgaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcg

SEQ ID NO: 3347 - DNA, 863 bp, Homo sapiens
cccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcgcccccaggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcg

SEQ ID NO: 3348 - DNA, 738 bp, Homo sapiens
atggcctctgtggggaggagagaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcg

SEQ ID NO: 3349 - DNA, 1605 bp, Homo sapiens
tctagagaagccaatcagtgtcgccggggtcccagttctaaagtccccacgcacccacccggactcaaaatctcctcagacgccgagatgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaagcctgagacagctgtcttgtgagggaccgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttccagaa

SEQ ID NO: 3350 - DNA, 1312 bp, Homo sapiens
agagtctcctcagacgccgagatgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctg

SEQ ID NO: 3351 - DNA, 1008 bp, Homo sapiens
agatgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggatcaggagcagaagtccctgttccccgctcagagactcgaactttccaatgaataggagattatcccagaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 3352 - DNA, 1008 bp, Homo sapiens
agatgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttg

SEQ ID NO: 3353 - DNA, 1005 bp, Homo sapiens
agatgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggatcaggagcagaagtctctgttccccgctcagagactcgaactttccaatgaatagattatcccagaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttg

SEQ ID NO: 3354 - DNA, 1008 bp, Homo sapiens
agatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 3355 - DNA, 1008 bp, Homo sapiens
agatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggatcaggagcagaagtccctgttccccgctcagagactcgaactttccaatgaataggagattatcccagaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttg

SEQ ID NO: 3356 - DNA, 1750 bp, Homo sapiens
agaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaacccggggcgcaggtcacgactccccatcccccacgtacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggacggggctgaccgcggggccggggccagggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccag

SEQ ID NO: 3357 - DNA, 1406 bp, Homo sapiens
agagtctcctcagacgccgagatgctggtcatggcgccccgaaccgtcctcctgctgctctcggcggccctggccctgaccgagacctgggccggctcccactccatgaggtatttcgacaccgccatgtcccggcccggccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcct

SEQ ID NO: 3358 - DNA, 1750 bp, Homo sapiens
agaatctcctcagacgccgagatgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaacccggggcgcaggtcacgactccccatcccccacgtacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggacggggctgaccgcggggccggggccagggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccag

SEQ ID NO: 3359 - DNA, 2601 bp, Homo sapiens
acgactcccgactataaagtccccatccggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccgggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattgaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttca

SEQ ID NO: 3360 - DNA, 2601 bp, Homo sapiens
acgactcccgactataaagtccccatccggactcaagaagttctcaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttca

SEQ ID NO: 3361 - DNA, 2601 bp, Homo sapiens; identical to SEQ ID NO: 3360

SEQ ID NO: 3362 - DNA, 2601 bp, Homo sapiens; identical to SEQ ID NO: 3360

SEQ ID NO: 3363 - DNA, 2601 bp, Homo sapiens; identical to SEQ ID NO: 3359

SEQ ID NO: 3364 - DNA, 2601 bp, Homo sapiens; identical to SEQ ID NO: 3360

SEQ ID NO: 3365 - DNA, 2601 bp, Homo sapiens; identical to SEQ ID NO: 3359

SEQ ID NO: 3366 - DNA, 1477 bp, Homo sapiens
aggactcagaggctgggatcatggtagatggaaccctccttttactcctctcggaggccctggcccttacccagacctgggcgggtgagtgcggggtcgggatggaaacggcctctaccgggagtagagaggggccggcccggcgggggcgaaggactcggggagccgcgccgggaggagggtcgggccgatctcagcccctcctcgcccccaggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccgggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctggagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggaagccggcttcccagcccaccatccccatcgtgggcatcattgctggcctggttctccttggatctgtggtctctggagctgtggttgctgctgtgatatggaggaagaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctatt

SEQ ID NO: 3367 - DNA, 1506 bp, Homo sapiens
aaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 3368 - DNA, 1281 bp, Homo sapiens
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatag

SEQ ID NO: 3369 - DNA, 1544 bp, Homo sapiens
gaaggagaggaagaggaagaggaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3370 - DNA, 884 bp, Homo sapiens
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3371 - DNA, 1059 bp, Homo sapiens
aaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 3372 - DNA, 884 bp, Homo sapiens
atggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3373 - DNA, 1544 bp, Homo sapiens
gaagaggaagaggaagaagaagaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3374 - DNA, 884 bp, Homo sapiens; identical to SEQ ID NO: 3370

SEQ ID NO: 3375 - DNA, 1506 bp, Homo sapiens
aaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 3376 - DNA, 1544 bp, Homo sapiens
gaagaggaagaggaagaggaagaggaagaagaagaagaagaagaagaagaagaagaagaagaagaagaagaagaagaagaagaagaagaagaagaagaagaagaagaagaagaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3377 - DNA, 1506 bp, Homo sapiens; identical to SEQ ID NO: 3375

SEQ ID NO: 3378 - DNA, 2295 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatgttgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaat

SEQ ID NO: 3379 - DNA, 578 bp, Homo sapiens
ttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 3380 - DNA, 578 bp, Homo sapiens
ttctctttctctcccaacccgtgtcaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 3381 - DNA, 578 bp, Homo sapiens; identical to SEQ ID NO: 3380

SEQ ID NO: 3382 - DNA, 639 bp, Homo sapiens
gcccagaccctccacccgggagagtcccaggcgcctttaccgagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 3383 - DNA, 884 bp, Homo sapiens; identical to SEQ ID NO: 3370

SEQ ID NO: 3384 - DNA, 578 bp, Homo sapiens; identical to SEQ ID NO: 3379

SEQ ID NO: 3385 - DNA, 796 bp, Homo sapiens
gcccagaccctccacccgggagagtcccaggcgcctttaccgagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3386 - DNA, 1408 bp, Homo sapiens
gaagaagaagaagaagaagaagaagaagaagaggaagaggaagaggaagaggaagaagaagaagaagaagaagaagaagaagaagaagaagaagaagaagaagaagaagaagaagaagaagaagaagaagaggaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcag

SEQ ID NO: 3387 - DNA, 1544 bp, Homo sapiens
gaagaagaagaagaagaggaagaggaagaggaagaagaagaagaagaagaagaagaagaagaagaagaagaagaagaagaagaagaagaagaagaagaagaagaagaagaagaagaagaggaagaagaagaaactgtctctagaccttcattctcaggacaagttcattgtctggcaccaagctccttggggtgaattttcttccaaaagagtccggggagtccaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3388 - DNA, 495 bp, Homo sapiens
ctgctgtgatgtggaggaagaagagctcaggacattttcttcccatagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 3389 - DNA, 495 bp, Homo sapiens; identical to SEQ ID NO: 3388

SEQ ID NO: 3390 - DNA, 796 bp, Homo sapiens; identical to SEQ ID NO: 3385

SEQ ID NO: 3391 - DNA, 1506 bp, Homo sapiens; identical to SEQ ID NO: 3375

SEQ ID NO: 3392 - DNA, 796 bp, Homo sapiens
gcccagaccctccacccgggagagtcccaggcgcctttacccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3393 - DNA, 1506 bp, Homo sapiens
aaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 3394 - DNA, 796 bp, Homo sapiens; identical to SEQ ID NO: 3385

SEQ ID NO: 3395 - DNA, 884 bp, Homo sapiens; identical to SEQ ID NO: 3370

SEQ ID NO: 3396 - DNA, 1544 bp, Homo sapiens; identical to SEQ ID NO: 3376

SEQ ID NO: 3397 - DNA, 578 bp, Homo sapiens; identical to SEQ ID NO: 3380

SEQ ID NO: 3398 - DNA, 30 bp, Homo sapiens
ctgctgtgatgtggaggaagaagagctcag

SEQ ID NO: 3399 - DNA, 1622 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagcctactcagtggtcagcggaaacttgatgataacatggtggtcaagcttatttctcctgggggtgctcttccaaggatatttgggctgcctccggagtcacagtgtcttgggccgccggaagcatttctaaggactttcagtaatggagattctatattagcttagagagaattgtttcaaaacatcagaaatgtatacttgaatgaaggacaacatgcatggagaaaggtggacaaaccataagtgggccgtggattttcacaaagtgaacactcaggaaagttgactcatactggtgtccagtgaagaaacccaggcgcataagagggacagttggatctcaggtttgtgcttgatctggaaaaggaagagcagagaccactaggaggcaccactgcactgctcatgagcccaggaggtggatgccggggctgagctcagggtggagagatgtcattgctcatcctccaggttccaggtgaaaacccacctgcccagcccatctggttctccctggttcttcaattctagggaggactgtcttcttctcacctccccggacgatgcttcttgacacaggaaagaggatgtgctgctagggtcatcatgtcct

SEQ ID NO: 3400 - DNA, 884 bp, Homo sapiens; identical to SEQ ID NO: 3370

SEQ ID NO: 3401 - DNA, 727 bp, Homo sapiens
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcag

SEQ ID NO: 3402 - DNA, 578 bp, Homo sapiens
ttctctttctctcccaacccgtgtcaggtccttcttcctggttactcataacgcggccccatttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctc

SEQ ID NO: 3403 - DNA, 495 bp, Homo sapiens; identical to SEQ ID NO: 3388

SEQ ID NO: 3404 - DNA, 1504 bp, Homo sapiens
agaagaagaggaggggggcggggaggagcaggaggaggaggaaagaaggaggagaaggagaaggagaaggagaagaagaagaagaagaagaaactgtctctacaccttcattctcaggacaagttcattgtctggcaccaagctccttggggtgaattttcttccaaaagagtccggggagtccaggtccttcttcctggttactcataacgcggccccatttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3405 - DNA, 1506 bp, Homo sapiens; identical to SEQ ID NO: 3375

SEQ ID NO: 3406 - DNA, 578 bp, Homo sapiens; identical to SEQ ID NO: 3380

SEQ ID NO: 3407 - DNA, 495 bp, Homo sapiens
ctgctgtgatgtggaggaagaagagctcaggacattttcttcccatagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatta

SEQ ID NO: 3408 - DNA, 1504 bp, Homo sapiens
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatt

SEQ ID NO: 3409 - DNA, 495 bp, Homo sapiens; identical to SEQ ID NO: 3388

SEQ ID NO: 3410 - DNA, 796 bp, Homo sapiens
gcccagaccctccacccgggagagtcccaggcgcctttacccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagata

SEQ ID NO: 3411 - DNA, 796 bp, Homo sapiens; identical to SEQ ID NO: 3410

SEQ ID NO: 3412 - DNA, 495 bp, Homo sapiens; identical to SEQ ID NO: 3388

SEQ ID NO: 3413 - DNA, 1622 bp, Homo sapiens
cccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagcctactcagtggtcagcggactcttgatgataacatggtggtcaagcttatttctcctgggggtgctcttccaaggatatttgggctgcctccggagtcacagtgtcttgggccgccggaagcatttctaaggactttcagtaatggagattctatattagcttagaaagaattgtttcaaaacatcagaaatgtatacttgaatgaaggacaacatgcatggagaaaggtggacaaaccataagtgggccgtggattttcacaaagtgaacactcaggaaagttgactcatactggtgtccagtgaagaaacccaggcgcataagagggacagttggatctcaggtttgtgcttgatctggaaaaggaagagcagagaccactaggaggcaccactgcactgctcatgagcccaggaggtggatgccggggctgagctcagggtggagagatgtcattgctcatcctccaggttccaggtgaaaacccacctgcccagcccatctggttctccctggttcttcaattctagggaggactgtcttcttctcacctccccagacgatgcttcttgacacaggaaagaggatgtgctgctagggtcaccatgtcct

SEQ ID NO: 3414 - DNA, 2295 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggcccagctcctgagtgtctctacctctcaaacaagtattctcatccaggagcaattttcccaccagaggacattagctatgtctggaaaaatgttttgttgccatgactggagtgaggagaaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatattgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaat

SEQ ID NO: 3415 - DNA, 1504 bp, Homo sapiens
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatt

SEQ ID NO: 3416 - DNA, 2295 bp, Homo sapiens; identical to SEQ ID NO: 3414

SEQ ID NO: 3417 - DNA, 1622 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagcctactcagtggtcagcggaaacttgatgataacatggtggtcaagcttatttctcctgggggtgctcttccaaggatatttgggctgcctccggagtcacagtgtcttgggccgccggaagcatttctaaggactttcagtaatggagattctatattagcttagagagaattgtttcaaaacatcagtaatgtatacttgaatgaaggacaacatgcatggagaaaggtggacaaaccataagtgggccgtggattttcacaaagtgaacactcaggaaagttgactcatactggtgtccagtgaagaaacccaggcgcataagagggacagttggatctcaggtttgtgcttgatctggaaaaggaagagcagagaccactaggaggcaccactgcactgctcatgagcccaggaggtggatgcccaggctgagctcagggtggagagatgtcattgctcatcctccaggttccaggtgaaaacccacctgcccagcccatctgcttctccctggttcttcaattctagggaggactgtcttcttctcacctccccggacgatgcttcttgacacaggaaagaggatgtgctgctagggtcatcatgtcct

SEQ ID NO: 3418 - DNA, 1622 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagcctactcagtggtcagcggaaacttgatgataacatggtggtcaagcttatttctcctgggggtgctcttccaaggatatttgggctgcctccggagtcacagtgtcttgggccgccggaagcatttctaaggactttcagtaatggagattctatattagcttagagagaattgtttcaaaacatcagaaatgtatacttgaatgaaggacaacatgcatggagaaaggtggacaaaccataagtaggccgtggattttcacaaagtgaacactcaggaaagttgactcatactggtgtccagtgaagaaacccaggcgcataagagggacagttggatctcaggtttgtgcttgatctggaaaaggaagagcagagaccactaggaggcaccactgcactgctcatgagcccaggaggtggatgccggggctgagctcagggtggagagatgtcattgctcatcctccaggttccaggtgaaaacccacctgcccagcccatctggttctccctggttcttcaattctagggaggactgtcttcttctcacctccccggacgatgcttcttgacacaggaaagaggatgtgctgctagggtcatcatgtcct

SEQ ID NO: 3419 - DNA, 1504 bp, Homo sapiens; identical to SEQ ID NO: 3415

SEQ ID NO: 3420 - DNA, 2295 bp, Homo sapiens; identical to SEQ ID NO: 3414

SEQ ID NO: 3421 - DNA, 1432 bp, Homo sapiens
tttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatga

SEQ ID NO: 3422 - DNA, 1281 bp, Homo sapiens
tttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatag

SEQ ID NO: 3423 - DNA, 1622 bp, Homo sapiens; identical to SEQ ID NO: 3417

SEQ ID NO: 3424 - DNA, 1281 bp, Homo sapiens
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatag

SEQ ID NO: 3425 - DNA, 2295 bp, Homo sapiens
cccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatattgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattacgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccttccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaat

SEQ ID NO: 3426 - DNA, 1504 bp, Homo sapiens; identical to SEQ ID NO: 3415

SEQ ID NO: 3427 - DNA, 1622 bp, Homo sapiens; identical to SEQ ID NO: 3417

SEQ ID NO: 3428 - DNA, 1504 bp, Homo sapiens; identical to SEQ ID NO: 3415

SEQ ID NO: 3429 - DNA, 1281 bp, Homo sapiens; identical to SEQ ID NO: 3424

SEQ ID NO: 3430 - DNA, 1281 bp, Homo sapiens; identical to SEQ ID NO: 3424

SEQ ID NO: 3431 - DNA, 1191 bp, Homo sapiens
aggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcct

SEQ ID NO: 3432 - DNA, 1384 bp, Homo sapiens
tttctcactcccattgggcgtcgggtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcaggctcccactccttgaggtatttcagcaccgctgtgtcgcggcccggccgcggggagccccgctacatcgccgtggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggactcttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactga

SEQ ID NO: 3433 - DNA, 1427 bp, Homo sapiens
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 3434 - DNA, 851 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 3435 - DNA, 1127 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 3436 - DNA, 1490 bp, Homo sapiens
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 3437 - DNA, 1443 bp, Homo sapiens
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 3438 - DNA, 867 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 3439 - DNA, 1143 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 3440 - DNA, 1497 bp, Homo sapiens
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 3441 - DNA, 1506 bp, Homo sapiens
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 3442 - DNA, 1127 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 3443 - DNA, 851 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 3444 - DNA, 1490 bp, Homo sapiens
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 3445 - DNA, 1490 bp, Homo sapiens
atatagtaacatagtgtggtactttgtcttgaggagatgtcctggactcacacggaaacttagggctacggaatgaagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 3446 - DNA, 1441 bp, Homo sapiens
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 3447 - DNA, 1427 bp, Homo sapiens
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 3448 - DNA, 1127 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 3449 - DNA, 1578 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaacttt

SEQ ID NO: 3450 - DNA, 1427 bp, Homo sapiens
actcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 3451 - DNA, 851 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 3452 - DNA, 1189 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 3453 - DNA, 1504 bp, Homo sapiens
atatagtaacatagtgtggtactttgtcttgaggagatgtcctggactcacacggaaacttagggctacggaatgaagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 3454 - DNA, 1141 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 3455 - DNA, 1434 bp, Homo sapiens
actcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 3456 - DNA, 858 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 3457 - DNA, 865 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttcca

SEQ ID NO: 3458 - DNA, 1427 bp, Homo sapiens; identical to SEQ ID NO: 3447

SEQ ID NO: 3459 - DNA, 1490 bp, Homo sapiens; identical to SEQ ID NO: 3444

SEQ ID NO: 3460 - DNA, 1127 bp, Homo sapiens; identical to SEQ ID NO: 3442

SEQ ID NO: 3461 - DNA, 1134 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 3462 - DNA, 851 bp, Homo sapiens; identical to SEQ ID NO: 3443

SEQ ID NO: 3463 - DNA, 1175 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaactttcca

SEQ ID NO: 3464 - DNA, 1175 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaactttcca

SEQ ID NO: 3465 - DNA, 1175 bp, Homo sapiens; identical to SEQ ID NO: 3463

SEQ ID NO: 3466 - DNA, 1191 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaactttccaca

SEQ ID NO: 3467 - DNA, 1175 bp, Homo sapiens
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaagcagtgacagtgcccagggctctaatgtgtctctcacggcttgtaaattgtgaaacagctgccctgtgtgggactgagtggcaagtccctttgtgacttcaagaaccctgactcctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgatgggttaattaaaggagaagattcctgaaatttgagagacaaaataaatggaagacatgagaactttcca

SEQ ID NO: 3468 - DNA, 1182 bp, Homo sapiens
atggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccaacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaagcagtgacagtgcccagggctctaatgtgtctctcacggcttgtaaattgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaa

SEQ ID NO: 3469 - DNA, 1592 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggtctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaacttt

SEQ ID NO: 3470 - DNA, 1578 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtgtaaatttactttttcaaattatttccaagagagattgatgggttaattaaaggagaagattcctgaaatttgagagacaaaataaatggaagacatgagaacttt

SEQ ID NO: 3471 - DNA, 1592 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcaccccgaaccctcttcctgctactctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcttgtccgaggatggagccgcgggcgccgtgggtggagcaggaggggccagagtattgggaagaggagacacggaacaccaaggcccacgcacagactgacagaatgaacctgcagaccctgcgcggctactacaaccagagcgaggccagttctcataccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggaggaagaagagctcagattgaaaaggagggagctactctcaggctgcaatgtgaaacagctgccctgtgtgggactgagtggcaagatttgttcatgccttccctttgtgacttcaagaaccctgacttctctttctgcagagaccagcccacccctgtgcccaccatgaccctcttcctcatgctgaactgcattccttccccaatcacctttcctgttccagaaaaggggctgggatgtctccgtctctgtctcaaatttgtggtgcactgagctataacttacttctgtattaaaattagaatctgagtataaatttagtttttcaaattatttccaagagagattgatgggttaattaaaggagaagattcctgaaatttgagagacaaaataaatggaagacatgagaacttt

SEQ ID NO: 3472 - DNA, 1578 bp, Homo sapiens; identical to SEQ ID NO: 3470

SEQ ID NO: 3473 - DNA, 1578 bp, Homo sapiens
agtgtggtactttgtcttgaggagatgtcctggactcacacggaaacttagggctacggaatgaagttctcactcccattaggtgacaggtttttagagaagccaatcagcgtcgccgcggtcctggttctaaagtcctcgctcacccacccggactcattctccccagacgccaaggatggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagattgaaaaggagggagctactctcaggctgcaatgtgaaacagctgccctgtgtgggactgagtggcaagtccctttgtgacttcaagaaccctgacttctctttgtgcagagaccagcccacccctgtgcccaccatgaccctcttcctcatgctgaactgcattccttccccaatcacctttcctgttccagaaaaggggctgggatgtctccgtctctgtctcaaatttgtggtccactgagctataacttacttctgtattaaaattagaatctgagtataaatttactttttcaaattatttccaagagagattgataggttaattaaaggagaagattcctgaaatttgagagacaaaataaatggaagacatgagaacttt

SEQ ID NO: 3474 - DNA, 1592 bp, Homo sapiens; identical to SEQ ID NO: 3469

SEQ ID NO: 3475 - DNA, 630 bp, Homo sapiens
atgggtcatgaacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccag

SEQ ID NO: 3476 - DNA, 1123 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3477 - DNA, 1010 bp, Homo sapiens
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3478 - DNA, 780 bp, Homo sapiens
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3479 - DNA, 1126 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3480 - DNA, 1007 bp, Homo sapiens
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3481 - DNA, 777 bp, Homo sapiens
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatatca

SEQ ID NO: 3482 - DNA, 871 bp, Homo sapiens
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtg

SEQ ID NO: 3483 - DNA, 611 bp, Homo sapiens
ttgactgacatctccgccccacaagggccccttctcacctggatcctaaagccttccagggggcctccaaagttgccctcggcttggtacgggctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgc

SEQ ID NO: 3484 - DNA, 871 bp, Homo sapiens; identical to SEQ ID NO: 3482

SEQ ID NO: 3485 - DNA, 611 bp, Homo sapiens; identical to SEQ ID NO: 3483

SEQ ID NO: 3486 - DNA, 1010 bp, Homo sapiens; identical to SEQ ID NO: 3477

SEQ ID NO: 3487 - DNA, 611 bp, Homo sapiens; identical to SEQ ID NO: 3483

SEQ ID NO: 3488 - DNA, 780 bp, Homo sapiens; identical to SEQ ID NO: 3478

SEQ ID NO: 3489 - DNA, 1003 bp, Homo sapiens
ctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 3490 - DNA, 871 bp, Homo sapiens; identical to SEQ ID NO: 3482

SEQ ID NO: 3491 - DNA, 611 bp, Homo sapiens; identical to SEQ ID NO: 3483

SEQ ID NO: 3492 - DNA, 611 bp, Homo sapiens; identical to SEQ ID NO: 3483

SEQ ID NO: 3493 - DNA, 1010 bp, Homo sapiens; identical to SEQ ID NO: 3477

SEQ ID NO: 3494 - DNA, 871 bp, Homo sapiens; identical to SEQ ID NO: 3482

SEQ ID NO: 3495 - DNA, 1126 bp, Homo sapiens; identical to SEQ ID NO: 3479

SEQ ID NO: 3496 - DNA, 780 bp, Homo sapiens; identical to SEQ ID NO: 3478

SEQ ID NO: 3497 - DNA, 518 bp, Homo sapiens
ctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgc

SEQ ID NO: 3498 - DNA, 1119 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 3499 - DNA, 871 bp, Homo sapiens; identical to SEQ ID NO: 3482

SEQ ID NO: 3500 - DNA, 518 bp, Homo sapiens
ctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgc

SEQ ID NO: 3501 - DNA, 1126 bp, Homo sapiens; identical to SEQ ID NO: 3479

SEQ ID NO: 3502 - DNA, 773 bp, Homo sapiens
cctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctt

SEQ ID NO: 3503 - DNA, 1126 bp, Homo sapiens; identical to SEQ ID NO: 3479

SEQ ID NO: 3504 - DNA, 1010 bp, Homo sapiens; identical to SEQ ID NO: 3477

SEQ ID NO: 3505 - DNA, 780 bp, Homo sapiens; identical to SEQ ID NO: 3478

SEQ ID NO: 3506 - DNA, 1010 bp, Homo sapiens; identical to SEQ ID NO: 3477

SEQ ID NO: 3507 - DNA, 1010 bp, Homo sapiens; identical to SEQ ID NO: 3477

SEQ ID NO: 3508 - DNA, 1126 bp, Homo sapiens; identical to SEQ ID NO: 3479

SEQ ID NO: 3509 - DNA, 780 bp, Homo sapiens; identical to SEQ ID NO: 3478

SEQ ID NO: 3510 - DNA, 1126 bp, Homo sapiens; identical to SEQ ID NO: 3479

SEQ ID NO: 3511 - DNA, 871 bp, Homo sapiens; identical to SEQ ID NO: 3482

SEQ ID NO: 3512 - DNA, 871 bp, Homo sapiens
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccatccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtg

SEQ ID NO: 3513 - DNA, 871 bp, Homo sapiens; identical to SEQ ID NO: 3482

SEQ ID NO: 3514 - DNA, 780 bp, Homo sapiens; identical to SEQ ID NO: 3478

SEQ ID NO: 3515 - DNA, 611 bp, Homo sapiens; identical to SEQ ID NO: 3483

SEQ ID NO: 3516 - DNA, 1397 bp, Homo sapiens
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3517 - DNA, 1397 bp, Homo sapiens
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3518 - DNA, 1397 bp, Homo sapiens
atttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3519 - DNA, 766 bp, Homo sapiens
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3520 - DNA, 1347 bp, Homo sapiens
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3521 - DNA, 663 bp, Homo sapiens
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3522 - DNA, 766 bp, Homo sapiens
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3523 - DNA, 612 bp, Homo sapiens
gatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcag

SEQ ID NO: 3524 - DNA, 612 bp, Homo sapiens; identical to SEQ ID NO: 3523

SEQ ID NO: 3525 - DNA, 1425 bp, Homo sapiens
cagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggctgatgttgctgcgtctatgtttgagggtgagaggggagcgtgcttgctttgaaatgaggctgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttc

SEQ ID NO: 3526 - DNA, 1397 bp, Homo sapiens; identical to SEQ ID NO: 3518

SEQ ID NO: 3527 - DNA, 1347 bp, Homo sapiens
tcccgtgagctggaaggaacagatttaatatctaggggctgggtattcccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3528 - DNA, 663 bp, Homo sapiens
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3529 - DNA, 1397 bp, Homo sapiens
atttgtccctgcctacctagccaatctgtccctgtttgggacactggactcccgtgagctggaaggaacagatttaatatctaggggctgggtattcccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3530 - DNA, 766 bp, Homo sapiens; identical to SEQ ID NO: 3522

SEQ ID NO: 3531 - DNA, 1397 bp, Homo sapiens; identical to SEQ ID NO: 3516

SEQ ID NO: 3532 - DNA, 1347 bp, Homo sapiens
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3533 - DNA, 612 bp, Homo sapiens; identical to SEQ ID NO: 3523

SEQ ID NO: 3534 - DNA, 612 bp, Homo sapiens; identical to SEQ ID NO: 3523

SEQ ID NO: 3535 - DNA, 663 bp, Homo sapiens; identical to SEQ ID NO: 3528

SEQ ID NO: 3536 - DNA, 766 bp, Homo sapiens; identical to SEQ ID NO: 3522

SEQ ID NO: 3537 - DNA, 612 bp, Homo sapiens; identical to SEQ ID NO: 3523

SEQ ID NO: 3538 - DNA, 663 bp, Homo sapiens
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3539 - DNA, 663 bp, Homo sapiens
gtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3540 - DNA, 663 bp, Homo sapiens; identical to SEQ ID NO: 3528

SEQ ID NO: 3541 - DNA, 766 bp, Homo sapiens; identical to SEQ ID NO: 3519

SEQ ID NO: 3542 - DNA, 663 bp, Homo sapiens; identical to SEQ ID NO: 3521

SEQ ID NO: 3543 - DNA, 1347 bp, Homo sapiens
tcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagtgacctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3544 - DNA, 1397 bp, Homo sapiens; identical to SEQ ID NO: 3516

SEQ ID NO: 3545 - DNA, 663 bp, Homo sapiens; identical to SEQ ID NO: 3521

SEQ ID NO: 3546 - DNA, 766 bp, Homo sapiens
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaatatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3547 - DNA, 1347 bp, Homo sapiens; identical to SEQ ID NO: 3543

SEQ ID NO: 3548 - DNA, 1347 bp, Homo sapiens; identical to SEQ ID NO: 3532

SEQ ID NO: 3549 - DNA, 612 bp, Homo sapiens; identical to SEQ ID NO: 3523

SEQ ID NO: 3550 - DNA, 766 bp, Homo sapiens; identical to SEQ ID NO: 3519

SEQ ID NO: 3551 - DNA, 612 bp, Homo sapiens; identical to SEQ ID NO: 3523

SEQ ID NO: 3552 - DNA, 612 bp, Homo sapiens; identical to SEQ ID NO: 3523

SEQ ID NO: 3553 - DNA, 1397 bp, Homo sapiens; identical to SEQ ID NO: 3518

SEQ ID NO: 3554 - DNA, 766 bp, Homo sapiens
gacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtt

SEQ ID NO: 3555 - DNA, 1347 bp, Homo sapiens; identical to SEQ ID NO: 3532

SEQ ID NO: 3556 - DNA, 1347 bp, Homo sapiens; identical to SEQ ID NO: 3543

SEQ ID NO: 3557 - DNA, 1425 bp, Homo sapiens
cagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttc

SEQ ID NO: 3558 - DNA, 639 bp, Homo sapiens
atgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagatggcacatttcctag

SEQ ID NO: 3559 - DNA, 639 bp, Homo sapiens; identical to SEQ ID NO: 3558

SEQ ID NO: 3560 - DNA, 1425 bp, Homo sapiens; identical to SEQ ID NO: 3525

SEQ ID NO: 3561 - DNA, 1241 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtgga

SEQ ID NO: 3562 - DNA, 639 bp, Homo sapiens; identical to SEQ ID NO: 3558

SEQ ID NO: 3563 - DNA, 1322 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtgga

SEQ ID NO: 3564 - DNA, 1241 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtgga

SEQ ID NO: 3565 - DNA, 1241 bp, Homo sapiens; identical to SEQ ID NO: 3561

SEQ ID NO: 3566 - DNA, 1322 bp, Homo sapiens; identical to SEQ ID NO: 3563

SEQ ID NO: 3567 - DNA, 1425 bp, Homo sapiens
cagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggctgatgttgctgcgtctatgtttgagggtgagaggggagcgtgcttgctttgaaatgaggctgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttc

SEQ ID NO: 3568 - DNA, 1241 bp, Homo sapiens; identical to SEQ ID NO: 3561

SEQ ID NO: 3569 - DNA, 1425 bp, Homo sapiens; identical to SEQ ID NO: 3525

SEQ ID NO: 3570 - DNA, 1425 bp, Homo sapiens
cagatttaatatctaggggctgggtattcccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacactggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggctgatgttgctgcgtctatgtttgagggtgagaggggagcgtgcttgctttgaaatgaggctgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttc

SEQ ID NO: 3571 - DNA, 639 bp, Homo sapiens; identical to SEQ ID NO: 3558

SEQ ID NO: 3572 - DNA, 1425 bp, Homo sapiens
cagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggctgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttc

SEQ ID NO: 3573 - DNA, 1322 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaatttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtgga

SEQ ID NO: 3574 - DNA, 1322 bp, Homo sapiens; identical to SEQ ID NO: 3563

SEQ ID NO: 3575 - DNA, 1425 bp, Homo sapiens; identical to SEQ ID NO: 3557

SEQ ID NO: 3576 - DNA, 3489 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcgaggtatctcgtaagaggggaggtccacctagacacactctaaatatgtggcctagaagattttggtctacttttctgtgaacagaatttaaaacatacaaagagataaatcaccataccacatagtttatgtcaggaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccaggcatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagatggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 3577 - DNA, 303 bp, Homo sapiens
accacacggactgagactgatttgattaaagcaccagagtgtaatggccctcagagcagggctggtcctggggttccacaccctgatgaccctcctgagcccgcaggaggcaggggccaccaaggggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 3578 - DNA, 303 bp, Homo sapiens; identical to SEQ ID NO: 3577

SEQ ID NO: 3579 - DNA, 3489 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccattgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttggcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcagaaatcaagatctcaacacaaatgtggctgccaagcactcagccctggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 3580 - DNA, 303 bp, Homo sapiens
accacacggactgagactgatttgattaaagcaccagagtgtaatggccctcagagcagggctggtcctggggttccacaccctgatgaccctcctgagcccgcaggaggcaggggccaccaaggggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 3581 - DNA, 303 bp, Homo sapiens; identical to SEQ ID NO: 3577

SEQ ID NO: 3582 - DNA, 3488 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggtctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccaggcatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 3583 - DNA, 3488 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacattctaaatatgtggcctagaagattttggtctacttttctgtgaacaaaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacagaactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagggaataagttgaaatcaatgaccagaagaccctgatggaagtggaggaaaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 3584 - DNA, 868 bp, Homo sapiens
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 3585 - DNA, 3489 bp, Homo sapiens
cttcttctttacctccgccttgttcctgtcctcaccacacggactgagactgatttgattaaagcaccagagtgcaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggcgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtatttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagaaggagtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaa

SEQ ID NO: 3586 - DNA, 3489 bp, Homo sapiens; identical to SEQ ID NO: 3576

SEQ ID NO: 3587 - DNA, 303 bp, Homo sapiens; identical to SEQ ID NO: 3577

SEQ ID NO: 3588 - DNA, 1307 bp, Homo sapiens
cacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaac

SEQ ID NO: 3589 - DNA, 3488 bp, Homo sapiens; identical to SEQ ID NO: 3582

SEQ ID NO: 3590 - DNA, 303 bp, Homo sapiens; identical to SEQ ID NO: 3580

SEQ ID NO: 3591 - DNA, 303 bp, Homo sapiens
accacacggactgagactgatttgattaaagcaccagagtgcaatggccctcagagcagggctggtcctggggttccacaccctgatgaccctcctgagcccgcaggaggcaggggccaccaaggggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtga

SEQ ID NO: 3592 - DNA, 868 bp, Homo sapiens
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggtctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 3593 - DNA, 868 bp, Homo sapiens
atttgattaaagcaccagagtgcaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggcgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 3594 - DNA, 1307 bp, Homo sapiens
cacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaac

SEQ ID NO: 3595 - DNA, 1307 bp, Homo sapiens
cacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggtgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaac

SEQ ID NO: 3596 - DNA, 1307 bp, Homo sapiens
cacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaac

SEQ ID NO: 3597 - DNA, 868 bp, Homo sapiens; identical to SEQ ID NO: 3584

SEQ ID NO: 3598 - DNA, 1307 bp, Homo sapiens; identical to SEQ ID NO: 3595

SEQ ID NO: 3599 - DNA, 1307 bp, Homo sapiens; identical to SEQ ID NO: 3588

SEQ ID NO: 3600 - DNA, 868 bp, Homo sapiens; identical to SEQ ID NO: 3592

SEQ ID NO: 3601 - DNA, 868 bp, Homo sapiens; identical to SEQ ID NO: 3584

SEQ ID NO: 3602 - DNA, 868 bp, Homo sapiens
atttgattaaagcaccagagtgtaatggccctcagagcagggctggtcctggggttccacaccctgatgaccctcctgagcccgcaggaggcaggggccaccaaggctgaccacatgggctcctacggaccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgc

SEQ ID NO: 3603 - DNA, 1307 bp, Homo sapiens
cacggactgagactgatttgattaaagcaccagagtgcaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggcgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtatttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaac

SEQ ID NO: 3604 - DNA, 543 bp, Homo sapiens
gaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacac

SEQ ID NO: 3605 - DNA, 1372 bp, Homo sapiens
gatttatactcttaatgggtactttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 3606 - DNA, 1372 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 3607 - DNA, 543 bp, Homo sapiens
gaatctgacccgactggattcctccatgactcaaggcacagactctccagaagactttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacac

SEQ ID NO: 3608 - DNA, 1372 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagactttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagtcccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 3609 - DNA, 543 bp, Homo sapiens; identical to SEQ ID NO: 3604

SEQ ID NO: 3610 - DNA, 543 bp, Homo sapiens; identical to SEQ ID NO: 3604

SEQ ID NO: 3611 - DNA, 543 bp, Homo sapiens; identical to SEQ ID NO: 3604

SEQ ID NO: 3612 - DNA, 1372 bp, Homo sapiens
gatttatactcttaatgggtactttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctatttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 3613 - DNA, 1372 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaaatagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgta

SEQ ID NO: 3614 - DNA, 543 bp, Homo sapiens; identical to SEQ ID NO: 3604

SEQ ID NO: 3615 - DNA, 1372 bp, Homo sapiens; identical to SEQ ID NO: 3605

SEQ ID NO: 3616 - DNA, 1423 bp, Homo sapiens
gactaccactacttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctacagtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaattttgggtgcaaagtcagggtgggcagaggaggtagaagatcaactcagttgtcgcatcattcatggttctttcatattgatgttcaatgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtattatttttgagtctaaa

SEQ ID NO: 3617 - DNA, 2028 bp, Homo sapiens
attaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaaagaagagcatgagcggagtgttccagggcacagtggtctctgttcatggcctgtttgctgctatgagggttaagacttaggggagaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttgctaaaaaaatcaaactcttcatattacccagaagggtaactgctgttccccgacctccacatatctgcatcaagctgaagttctgtgtcctcatgagctgattttacctttacacagatattggggaacgtgatgatgatatgccctggacctcagcatcctctgtttgatgctgcagaggaaactgaggactgggggagagggtgtgtccctcagggtaccctgtgctgaccatgcctcgtctctcttctccaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3618 - DNA, 1059 bp, Homo sapiens
tctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3619 - DNA, 1214 bp, Homo sapiens
ccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3620 - DNA, 1059 bp, Homo sapiens
tctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3621 - DNA, 2027 bp, Homo sapiens
attaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaagaagagcatgagcggagtgttccagggcacagtggtctctgttcatggcctgtttgctgctatgagggttaagacttaggggaaaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctacagagggaactgaggactaggggagagggtgtgtccctcagggtaccctgtgctgatcatgcctcgtctctcttctccaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3622 - DNA, 721 bp, Homo sapiens
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctttaatgcccacctgcccctgcccag

SEQ ID NO: 3623 - DNA, 1059 bp, Homo sapiens
tctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtta

SEQ ID NO: 3624 - DNA, 721 bp, Homo sapiens
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 3625 - DNA, 721 bp, Homo sapiens; identical to SEQ ID NO: 3622

SEQ ID NO: 3626 - DNA, 2028 bp, Homo sapiens; identical to SEQ ID NO: 3617

SEQ ID NO: 3627 - DNA, 1214 bp, Homo sapiens
ccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3628 - DNA, 721 bp, Homo sapiens; identical to SEQ ID NO: 3624

SEQ ID NO: 3629 - DNA, 721 bp, Homo sapiens
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 3630 - DNA, 1059 bp, Homo sapiens; identical to SEQ ID NO: 3620

SEQ ID NO: 3631 - DNA, 721 bp, Homo sapiens
ctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgactcctgcactgactcctgaggacttttgtctgggattggtcatcactcttctgtaatgcccacctgcccctgcccag

SEQ ID NO: 3632 - DNA, 1059 bp, Homo sapiens; identical to SEQ ID NO: 3623

SEQ ID NO: 3633 - DNA, 1214 bp, Homo sapiens; identical to SEQ ID NO: 3627

SEQ ID NO: 3634 - DNA, 1214 bp, Homo sapiens
ccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3635 - DNA, 1214 bp, Homo sapiens
ccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtta

SEQ ID NO: 3636 - DNA, 1214 bp, Homo sapiens; identical to SEQ ID NO: 3635

SEQ ID NO: 3637 - DNA, 1059 bp, Homo sapiens; identical to SEQ ID NO: 3618

SEQ ID NO: 3638 - DNA, 2027 bp, Homo sapiens
attaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaaagaagagcatgagcggagtgttccagggcacagtggtctctgttcatggcctgtttgctgctatgagggttaagacttaggggagaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctgcagaggaaactcaggactgggggagagggtgtgtccctcagggtaccctgtgctgatcatgcctcatctctcttctccaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtt

SEQ ID NO: 3639 - DNA, 721 bp, Homo sapiens; identical to SEQ ID NO: 3631

SEQ ID NO: 3640 - DNA, 2026 bp, Homo sapiens
attaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaagaagagcatgagcggagtgttccagggcacagtggtctctgttcatggcctgtttgctgctatgagggttaagacttaggggaaaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttactaaaaaaatcaaactcttcatattacccagaagggtaactgctgttcccccacctccacatatctgcatcaagctgaagttctgtgtcctcatgagctgattttacctttacacagatattggggaacgtgatgatgatatgccctggacctcagcatcctctgtttgatgctacagagggaactgaggactaggggagagggtgtgtccctcagggtaccctgtgctgatcatgcctcgtctctcttctccaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3641 - DNA, 1214 bp, Homo sapiens; identical to SEQ ID NO: 3634

SEQ ID NO: 3642 - DNA, 1059 bp, Homo sapiens
tctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3643 - DNA, 2027 bp, Homo sapiens; identical to SEQ ID NO: 3638

SEQ ID NO: 3644 - DNA, 2026 bp, Homo sapiens; identical to SEQ ID NO: 3640

SEQ ID NO: 3645 - DNA, 721 bp, Homo sapiens; identical to SEQ ID NO: 3629

SEQ ID NO: 3646 - DNA, 2027 bp, Homo sapiens; identical to SEQ ID NO: 3621

SEQ ID NO: 3647 - DNA, 1059 bp, Homo sapiens; identical to SEQ ID NO: 3642

SEQ ID NO: 3648 - DNA, 1214 bp, Homo sapiens; identical to SEQ ID NO: 3619

SEQ ID NO: 3649 - DNA, 1122 bp, Homo sapiens
tccggcaggtacataagatccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagtta

SEQ ID NO: 3650 - DNA, 2027 bp, Homo sapiens; identical to SEQ ID NO: 3638

SEQ ID NO: 3651 - DNA, 1122 bp, Homo sapiens
tccggcaggtacataagttccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcagtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3652 - DNA, 1122 bp, Homo sapiens; identical to SEQ ID NO: 3649

SEQ ID NO: 3653 - DNA, 1122 bp, Homo sapiens
tccggcaggtacataagatccattaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccacctgcaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3654 - DNA, 1122 bp, Homo sapiens; identical to SEQ ID NO: 3651

SEQ ID NO: 3655 - DNA, 1122 bp, Homo sapiens; identical to SEQ ID NO: 3653

SEQ ID NO: 3656 - DNA, 2027 bp, Homo sapiens
attaggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcggggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctacgcacgaccttgcagcggcaagtggagcccacagtgaccatctccccatccaggacagaggccctcaaccaccacaacctgctggtctgctcagtgacagatttctatccagcccagatcaaagtccagtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgggtggtgttggaggcttcgtgctggggctgatcttcctcgggctgggccttatcatccgtcacaggggtcagaaaggacctcgagggcctccacctgcaggtaatatttcagccatgatccagtcaggggagagggcacaggcataagagggaagagccatggtgaaaccgcatctctactaaaaatacaaaaattagctggacgtggtggtgtgcatctgtaatcccggctacttgggaggttgaggcaagagaatcacttgaacccaggaggcagaggttgcagtgagccaagatggcgccactgcactccagtctgggcgatagagctagagtctgtctcaaaaaaaaaaaaaagaagagcatgagcggagtgttccagggcacagtggtctctgttcatggcctgtttgctgctatgagggttaagacttaggggagaagtttgccagtttctacgaatctccagagattgtttcctagaaccaggccttaactttggtggcatctttttgtgaaatgtggggacagagccacatcttgaatgtgagatagtagggtgatgcccactttgtgccacattttgttagctactgcctgtaggcattttcagtgactaaaagaggctgctagtggtggagatgaagtgtcacccaatttgctaaaaaaatcaaactcttcatattacccagaagggtaactgctgttccccgacctccacatatctgcatcaagctgaagttctgtgtcctcatgagctgattttacctttacacagatattggggaacgtgatgatgatatgccctggacctcagcatcctctgtttgatgctgcagaggaaactgaggactgggggagagggtgtgtccctcagggtaccctgtgctgaccatgcctcgtctctcttctccaggactcctgcactgactcctgaggacttttgtctgggattggtcatcactcttctttaatgcccacctgcccctgcccagaattcctagctgcctgtttcaccctgtcccactgaggtcagagtcctacagtggctcatgcagccacaggtcaccttctgtgatccccaccccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtt

SEQ ID NO: 3657 - DNA, 1122 bp, Homo sapiens
tccggcaggtacataagatccattaggtttgagctgtgttgactaccactgctttttccttggtctcacttacgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactgactcctgaggacttttgtctgggattggtcatcactcttctgtaatgcccacctgcccctgcccagaattcctagctgcctgtgtcaccctgtcccactgaggtcagagtcctacagtggctcatgcagccacaggtcaccttctgtgatccccatcccaaggcactggtggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctgactttagtgctttttcccataattaaacctgattctgagtta

SEQ ID NO: 3658 - DNA, 2027 bp, Homo sapiens; identical to SEQ ID NO: 3656

SEQ ID NO: 3659 - DNA, 2027 bp, Homo sapiens; identical to SEQ ID NO: 3638

SEQ ID NO: 3660 - DNA, 1169 bp, Homo sapiens
ttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3661 - DNA, 1280 bp, Homo sapiens
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtggaa

SEQ ID NO: 3662 - DNA, 1123 bp, Homo sapiens
actcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3663 - DNA, 1280 bp, Homo sapiens
ttttaatggtcagactctattacaccccacattctcttttcttttattcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3664 - DNA, 1280 bp, Homo sapiens
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacaaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagtgtggatatgcctcttcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3665 - DNA, 1123 bp, Homo sapiens
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaatgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3666 - DNA, 1280 bp, Homo sapiens; identical to SEQ ID NO: 3663

SEQ ID NO: 3667 - DNA, 1280 bp, Homo sapiens; identical to SEQ ID NO: 3663

SEQ ID NO: 3668 - DNA, 1123 bp, Homo sapiens
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3669 - DNA, 1280 bp, Homo sapiens
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaatgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3670 - DNA, 1123 bp, Homo sapiens; identical to SEQ ID NO: 3662

SEQ ID NO: 3671 - DNA, 1123 bp, Homo sapiens; identical to SEQ ID NO: 3662

SEQ ID NO: 3672 - DNA, 1123 bp, Homo sapiens
actcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtggaa

SEQ ID NO: 3673 - DNA, 1280 bp, Homo sapiens
ttttaatggtcagactctattacaccccacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaa

SEQ ID NO: 3674 - DNA, 919 bp, Homo sapiens
tttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaagccctctcccagagactacagagaacgtggtgtgtgccctgggcctgactgtgggtctggtgggcatcattattgggaccatcttcatcatcaagggattgcgcaaaagcaatgcagcagaacgcagggggcctctgtaaggcacatggaggtgatggtgtttcttagagagaagatcactgaagaaacttctgctttaatggctttacaaagctggcaatattacaatccttgacctcagtgaaagcagtcatcttcagcattttccagccctatagccaccccaagagtggttatgcctcctcgattgctccatactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtgg

SEQ ID NO: 3675 - DNA, 1250 bp, Homo sapiens
acattctcttttcttttattcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3676 - DNA, 646 bp, Homo sapiens
attcttgtctgttctgcctcactcccgagctctactgactcccaaaagagcgcccaagaagaaaatggccataagtggagtccctgtgctaggatttttcatcatagctgtgctgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3677 - DNA, 922 bp, Homo sapiens
ttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatctt

SEQ ID NO: 3678 - DNA, 919 bp, Homo sapiens
tttattcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3679 - DNA, 919 bp, Homo sapiens; identical to SEQ ID NO: 3678

SEQ ID NO: 3680 - DNA, 646 bp, Homo sapiens; identical to SEQ ID NO: 3676

SEQ ID NO: 3681 - DNA, 919 bp, Homo sapiens
tttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3682 - DNA, 646 bp, Homo sapiens; identical to SEQ ID NO: 3676

SEQ ID NO: 3683 - DNA, 1250 bp, Homo sapiens
acattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3684 - DNA, 919 bp, Homo sapiens; identical to SEQ ID NO: 3678

SEQ ID NO: 3685 - DNA, 646 bp, Homo sapiens
attcttgtctgttctgcctcactcccgagctctactgactcccaacagagcgcccaagaagaaaatggccataagtggagtccctgtgctaggatttttcatcatagctgtgctgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3686 - DNA, 646 bp, Homo sapiens
attcttgtctgttctgcctcactcccgagctctactgactcccaacagagcgcccaagaagaaaatggccataagtggagtccctgtgctaggatttttcatcatagctgtgctgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3687 - DNA, 1250 bp, Homo sapiens; identical to SEQ ID NO: 3675

SEQ ID NO: 3688 - DNA, 919 bp, Homo sapiens
tttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaagccctctcccagagactacagagaatgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtgg

SEQ ID NO: 3689 - DNA, 646 bp, Homo sapiens
attcttgtctgttctgcctcactcccgagctctactgactcccaacagagcgcccaagaagaaaatggccataagtggagtccctgtgctaggatttttcatcatagctgtgctgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatagacaagttcaccccaccagtggtcaatgtcacgtggcttcgaaatggaaaacctgtcaccacaggagtgtcagagacagtcttcctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgaagatcttgggtgg

SEQ ID NO: 3690 - DNA, 1250 bp, Homo sapiens; identical to SEQ ID NO: 3675

SEQ ID NO: 3691 - DNA, 1184 bp, Homo sapiens
atagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccacacattgcattattaaatgtttctcaaacatggagttaaaaa

SEQ ID NO: 3692 - DNA, 1172 bp, Homo sapiens
atagttctccctgagtgagacttgcctgctgctctgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacagccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccatgcatctgtaccccccttgtgccacacattgcattattaaatgtttctcaaaca

SEQ ID NO: 3693 - DNA, 1184 bp, Homo sapiens; identical to SEQ ID NO: 3691

SEQ ID NO: 3694 - DNA, 1379 bp, Homo sapiens
tcgggcctcggtcgccacggtaacgcgcgcgggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggtttgtatgcagtgaaaatccgagctgaggccatgcaggaagcttcagaagctgtccccagtgggatgctgtctgtcctcggccagcctcagtccaagttcaacttcgcctgtttggaagcccgggaacactgcaagtctttaggcatagagaaccccgtatgtgaagtgtccaactacctctttccagattgcagggtgatttcaggacaccaagaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatga

SEQ ID NO: 3695 - DNA, 1134 bp, Homo sapiens
gggcaggtgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcggtgattgagaactgtgttgctgctgctggattcagtgtgggagagtttgcagccctagtgtttgccggagccatggaatttgctgaaggctctacggtttctccagaagaattcctctaagtttcatttcagacgcaccaggatgttgccggttagtggcgcattccacacccgcctcatggagccagccgtggagcccctgacgcaagctttaaaggcagtcgacattaagaagcctctggtttctgtctactccaacgtccacgcgcatagatacaggcatcccgggcacatccacaagctgctggcccagcagctggtctccccagtgaagtgggagcagacgatgcatgccatatacgaaaggaaaaagggcagggggttcccccaaactttcgaagtaggccctggcaggcagctgggagccatcctgaagagctgtaacatgcaggcctggaagtcctacagcgccgtggatgtgctgcagaccctcgaacatgtggacctggaccctcaggagcccccgagatgactgcagggggctcaaatgcgatgaccccctctgtcctcctgaggagaggctgtaggctgtgcctgtcgccccctaccttcctaatggctcctcctctgaggagtgaaagggatttgtttgcaacgtgctttgaaggccacataaaaagccctaaaaatgagta

SEQ ID NO: 3696 - DNA, 3658 bp, Homo sapiens
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 3697 - DNA, 3801 bp, Homo sapiens
aggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctggtgaggcccaagggcacttcctgtctctgcagcgggcctgggggcagctaggcgctgaggcccgggtcctcacacccctccttggcccttctggccccagctgtgaactccacctggcttattatttacagagccagccccgaggcttcctggcactagttgtggtggacaacggctcccgggagctggcatggcaggccctgagcagcagtgcaggcatctggaaggtggacaaggtccttctaggggcccgccgccggcccttccggctggagtttgtcggtttggtggacttggatggccctgaccagcagggagctggggtggacaacgtgaccctgagggactgtagccccacagtgaccaccgagagagacagagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 3698 - DNA, 3895 bp, Homo sapiens
ggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactgcagggactgctcagatgaggcccagtgtggttaccacggggcctcgcccaccctgggcgcccccttcgcctgtgacttcgagcaggacccctgcggctggcgggacattagtacctcaggctacagctggctccgagacagggcaggggccgcactggagggtcctgggcctcactcagaccacacactgggcaccgacttgggctggtacatggccgttggaacccaccgagggaaagaggcatccaccgcagccctgcgctcgccaaccctgcgagaggcagcctcctcttgcaagctgaggctctggtaccacgcggcctctggagatgtggctgaactgcgggtggagctgacccatggcgcagagaccctgaccctgtggcagagcacagggccctggggccctggctggcaggagttggcagtgaccacaggccgcatccggggtgacttccgagtgaccttctctgccacccgaaatgccacccacaggggcgctgtggctctagatgacctagagttctgggactgtggtctgcccaccccccaggccaactgtcccccgggacaccaccactgccagaacaaggtctgcgtggagccccagcagctgtgcgacggggaagacaactgcggggacctgtctgatgagaacccactcacctgtggccgccacatagccaccgactttgagacaggcctgggcccatggaaccgctcggaaggctggtcccggaaccaccgcgctggtggtcctgagcgcccctcctggccacgccgtgaccacagccggaacagtgcacagggctccttcctggtctccgtggccgagcctggcacccctgctatactctccagccccgaattccaagcctcaggcacctccaactgctcgctggtcttctatcagtacctgagtgggtctgaggctggctgcctccagctgttcctgcagactctggggcccggcgccccccgggcccccgtcctgctgcggaggcgccgaggggagctggggaccgcctgggtccgagaccgtgttgacatccagagcgcctaccccttccagatcctcctggccgggcagacaggcccggggggcgtcgtgggtctggacgacctcatcctgtctgaccactgcagaccagtctcggaggtgtccaccctgcagccgctgcctcctgggccccgggccccagccccccagcccctgccgcccagctcgcggctccaggattcctgcaagcaggggcatcttgcctgcggggacctgtgtgtgcccccggaacaactgtgtgacttcgaggagcagtgcgcagggggcgaggacgagcaggcctgtggcaccacagactttgagtcccccgaggctgggggctgggaggacgccagcgtggggcggctgcagtggcggcgtgtctcagcccaggagagccaggggtccagtgcagctgctgctgggcacttcctgtctctgcagcgggcctgggggcagctaggcgctgaggcccgggtcctcacacccctccttggcccttctggccccagctgtgaactccacctggcttattatttacagagccagccccgaggcttcctggcactagttgtggtggacaacggctcccgggagctggcatggcaggccctgagcagcagtgcaggcatctggaaggtggacaaggtccttctaggggcccgccgccggcccttccggctggagtttgtcggtttggtggacttggatggccctgaccagcagggagctggggtggacaacgtgaccctgagggactgtagccccacagtgaccaccgagagagacagagaggtctcctgtaactttgagcgggacacatgcagctggtacccaggccacctctcagacacacactggcgctgggtggagagccgcggccctgaccacgaccacaccacaggccaaggccactttgtgctcctggaccccacagaccccctggcctggggccacagtgcccacctgctctccaggccccaggtgccagcagcacccacggagtgtctcagcttctggtaccacctccatgggccccagattgggactctgcgcctagccatgagacgggaaggggaggagacacacctgtggtcgcggtcaggcacccagggcaaccgctggcacgaggcctgggccaccctttcccaccagcctggctcccatgcccagtaccagctgctgttcgagggcctccgggacggataccacggcaccatggcgctggacgatgtggccgtgcggccgggcccctgctgggcccctaattactgctcctttgaggactcagactgcggcttctcccctggaggccaaggtctctggaggcggcaggccaatgcctcgggccatgctgcctggggccccccaacagaccataccactgagacagcccaagggcactacatggtggtggacacaagcccagacgcactaccccggggccagacggcctccctgacctccaaggagcacaggcccctggcccagcctgcttgtctgaccttctggtaccacgggagcctccgcagcccaggcaccctgcgggtctacctggaggagcgcgggaggcaccaggtgctcagcctcagtgcccacggcgggcttgcctggcgcctgggcagcatggacgtgcaggccgagcgagcctggagggtggtgtttgaggcagtggccgcaggcgtggcacactcctacgtggctctggatgatctgctcctccaggacgggccctgccctcagccaggttcctgtgattttgagtctggcctgtgtggctggagccacctggcctggcccggcctgggcggatacagctgggactggggcgggggagccaccccctctcgttacccccagccccctgtggaccacaccctgggcacagaggcaggccactttgccttctttgaaactggcgtgctgggccccgggggccgggccgcctggctgcgcagcgagcctctgccggccaccccagcctcctgcctccgcttctggtaccacatgggttttcctgagcacttctacaagggggagctgaaggtactgctgcacagtgctcagggccagctggctgtgtggggcgcaggcgggcatcggcggcaccagtggctggaggcccaggtggaggtagccagtgccaaggagttccagatcgtgtttgaagccactctgggcggccagccagccctggggcccattgccctggatgacgtggagtatctggctgggcagcattgccagcagcctgcccccagcccggggaacacagccgcacccgggtctgtgccagctgtggttggcagtgccctcctattgctcatgctcctggtgctgctgggacttgggggacggcgctggctgcagaagaaggggagctgccccttccagagcaacacagaggccacagcccctggctttgacaacatccttttcaatgcggatggtgtcaccctcccggcatctgtcaccagtgatccgtagaccaccccagacaaggccccgcttcctcacgtgacatccagcacttggtcagaccctagccagggaccggacacctgccccgcccaggctgggacaggctgcaggtctcaggatatgctgaggcctgggcgttccctgccctgtgctgactctgttgctctgtgaataaacaccctggcccatgagggcagccc

SEQ ID NO: 3699 - DNA, 2627 bp, Homo sapiens
ggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagacacagcggtcctggggttgccttccagatgaagatctatcaaagatttgaagtcttgtgtatgtggtcctagaggaccccaggctgttataccgatccatgaggcatctgaccccttccaaaggatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 3700 - DNA, 2461 bp, Homo sapiens
gtcctttaagttgcaagggcctggggtggcaggggtagaggaatgcatgaagattcctcaccaatgcctgatactgtcagtcttcgtaacgttagcctttctagcagaaggaaactctatctatctatctatctatctatatttatttattttatttttttgagatggagtctcactcttgtcgcccagactggagtgcagtggcatagtctcggctcactgcaacttctgcctcccgggttcaagcgattctcctgcctcagcctcccgagtagctaggattacaggcgcccgcaaccacgcccagctaatttttgtatttttagtagagacagggtttcactgtgttggccaggctggtctcgaactcctgacctcaggcgatctgcctgccttggcctcccaaagtgctgggattacaggcatgagccactgagcccagctggaaacactatattcttgttgagcccctggaagtttatttatatactcattctgcatttttgttcaatccatactctgctaagcactggagaaaacagaggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaa

SEQ ID NO: 3701 - DNA, 3199 bp, Homo sapiens
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggagggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgt

SEQ ID NO: 3702 - DNA, 4641 bp, Homo sapiens
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaacttcccataacccagccccctttcccaccctccctgatgccctccctgggagggggcctgaaacactggggctgttgtgcagagcaaggagctcaggtcctaacactgaagtgacagctcttcctcccctgacccttttttttttttgagacccagagtctcgttcagtcgcccaggctggagtgcagtggtgcaatcttggctcactgcaacctccacctcctgggttcaagcagttctcctgcctcagcttccccagtagcagggtgcgtcaccacacccggctaattttttgtatttttagtaaagacgaggttttgccatgttgcctaggctggtcttgaactcctgagctcaggtgatccgcccacctcagcctcccaaagtgcggggattacaggcatgagccaccacacccagtcctttcctggcacatttgcagcttgtcaacacagcggaaatcacgggagaatgttgagcccttccctgggctcagctgcttgctctgttcataagctttaatagcccccggggctctgggccaggtgacccggctttaaatccctgctgtgtgaacttaggcaggtacctcccctctctgggctcttcttttccatcaagcagacagaaaacctcaaccccacaaggttgctgtgagaagaagtgggaagctgctggttccctgggcacaggaagtgcttgttccttgttctggagactcaagacattcccagaatcttcttaagcagagctgctggggagtagcccctgtagcaagtaccatgctcttgacaggcagcatgagagcgtgactcccatgacccacctgtgctcaaaaaaaaaaaaaaaaaaaagcaaaccaggaaaactgactacacaaacattgtagaaagattagaaaatagaagcagaaagaagactcattggccatcccactctctggggtgaatactgttatattttcttctaggcctttttctatgaatatatagaatatagattttgccaccgtggtatcctactatgcacactgttttcttataatctgcttttgcacttaactgtacattgtgaacctctttccatgtcaacaaatacatgtttatctcatcgctgta

SEQ ID NO: 3703 - DNA, 1915 bp, Homo sapiens
tttgtcctctgcttcccaactcttgccctatctttctattgtaccactccaaatatttcttatcacaatgttgctgttagtagtaacactagtaaatctgagtatttataagctcataaagcttgttacagccttaagcaaaaagcttggggccaagggcgttttaaaaaatgcacactttatgaggtgcaactgcggagaaatgaggacgcgttcttaagctttggtattcacatggtggtggtgctggtagaggctgttacatttcttccagtgaagctgttcttgcagccgccttggaattcacttcagggccagtttatgagccaccccaagtaatctgcttggagtctgagcatcataccttgtatttgaccaaaaatggtattcctgagctcagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 3704 - DNA, 1208 bp, Homo sapiens
cagggtcgcagggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 3705 - DNA, 620 bp, Homo sapiens
ggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggagttccatgtagaggcctgattccattccagtcaggttattgggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggc

SEQ ID NO: 3706 - DNA, 1503 bp, Homo sapiens
agaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttacagaaatatgacactgaccctttgcatttacaagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 3707 - DNA, 1539 bp, Homo sapiens
gggagcggcgcggcggcgcgggagtgccacctgattcactgcacttggaaccagatgatgttgggctctttccagaagtcaaatccttcctgggaggatgaagatctgccagctctgaggattctggctgggaagaaaaagagcctcaagctttgaaggccattcccatggtagacagagctgatgtgaaaagtggccatcctgttgccccaggcacatgaccttctgaagtgaccaggctgaaagggaagcaatactcgtgtgatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttcagaa

SEQ ID NO: 3708 - DNA, 1311 bp, Homo sapiens
gggaactacttccgggggagcggcgcggcggcgcgggaggatctctcaccccgtcactcagggtggcgcaatcacgactcattggctcactgcagcctagacctcccagctggagcaattctcctgcctcagccttctgagtagctgggactacagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcctcctgatcagtcacctttgttgctgctgtgtagacagagccaggcctcacctgtttgtttaggccaagatgccatggacatgcagcgttagtgatcccactagctgtgacagccaggcccagaaaatgcctggcgtgagagccagcagacagccaggccagggtaggcagtgcctgcttctgctccatcaggtgcaggggatttggctgaaggcgtgcatatttcctgggcacaaacttcctgagcctctgaaatgggaggctcgtcaatttcagaccaacctcttttcaacccatcatagcacgttcaaggtgtgccttttacttctacctgtacatcccccatcccttcaattctttcattccctgaccagtgagagggttcctgggggaagtatggtgaataaactgacatgcatgcttc

SEQ ID NO: 3709 - DNA, 1930 bp, Homo sapiens
agtctaaagcctggctcccttccggcctggcgcgctacggttcccgcaggcgctccgcttcagcaccgcgggcgtggacagctccggggcgcgaggctctgggactcatctgcaggaagtgaacctggcaggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaa

SEQ ID NO: 3710 - DNA, 2685 bp, Homo sapiens
cctctctcccgcgctccggaaggcctgcgtccccgctccccagccaggcgccaccacctgccgcccaggcagccaggcgactcttctttcgcgggtcacgcggcctgactcaggcccctgctcctgtggccccgaaactcgccgttcgctgggccttgcgttgcactcggcgtgcagttccccctcggctcgcggccacttggtccgcgccgcctgcgtcctgtgtgccgagcccgcccgcactgcggggacaggccgggcgccgcccacgccgcgctctgccgggcgcacagtctgcctgggaagcgcgcggccgggcgggcggccatggcgcggcacgctgggaggtagcgcggcggctgcaggagcgcacagtcggccatggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaa

SEQ ID NO: 3711 - DNA, 2327 bp, Homo sapiens
tcttctttcgcgggtcacgcggcctgactcaggcccctgctcctgtggccccgaaactcgccgttcgctgggccttgcgttgcactcggcgtgcagttccccctcggctcgcggccacttggtccgcgccgcctgcgtcctgtgtgccgagcccgcccgcactgcggggacaggccgggcgccgcccacgccgcgctctgccgggcgcacagtctgcctgggaagcgcgcggccgggcgggcggccatggcgcggcacgctgggaggtagcgcggcggctgcaggagcgcacagtcggccatggcccggcggcggcgccgcgcctgcatcgctctgttcctggtgctgctcttcgccttcggcaccctcatgggtctgcgcacgctcaaggctccggacggactcccggcgctgggcccgggcctggagctggcgccctttgagcgacgcccagagggggcccccgcgcccgctgccagggccccggcagcccctgccgcgccgcccccgccgccgccgccgccccgcaccgcggaccctggcggctcccctgggccggcacccgcggaggccgagcccgcccccgtgcagagcctgcgcgtctactcggacctgcacgccttctactactcgtggtacgggagcccgcggcgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaa

SEQ ID NO: 3712 - DNA, 3178 bp, Homo sapiens
tttcttttttccagggtatcaacggtttctgtacagcacagattatgacagcgtctttcttaagattctgtggacctgactgacactagaaaagccgcagtagcatgtgacatggaagtttatattatcagggtgtgctcacctggttgcaaatttgagaccaaagttttactttaacacttggagctggtaaaggatgttttattcattgtgtttctgacagatggaacaagttaaggttaccttctcaatatgaggactaaagcttttagccaatatttgtggagaagacacatttaagattttcttttgcccatacatgcaatgttatggaggctgtgaccacattttaggcaagaaactgaaagaacatcaagcacctatctggatgtctccaaagcctcatctggataaaatatccaatctatttttcaatcagcctttttttttcctttttcaacctcagacaattgcttttggggtcctagagtcccttgaaagttatgatggaaataggagacctaaagttcaggtgactgaagggctgaagcaggaaggaaaaacgtctgggaggacaggtagacagaggaaagaggtctgaagaggcacatatcaaaagattcaagaaagctgaagggaagattgaaggtagtaaaaggatgaaggaggagcagaagcaatgggaaggaagagatctcagaggactcacttcgggaaaatcttcagtttcccaaagagatcctgaagtctcaaattatccttaacaaaaccatgaccacaagaaaggaagtggagtatacgatcagtgagagtttaagaagggggtttccgttgactaaaaagttaccgtgggagaaataggatcaaatagaacagagttgcctcacaaagaaccaaggaaaatatttcagctcagggattcaagaagtaaattcccactcaaagacagaaacaggaagtaagatttacaattcagccagtaccttcctaacagagaagcatgtgactataccaacttcttacaaaaagaaacaggactaactcagcctctgtatagtgtactcaggctctctcagccctcactgtgcttcaacagacttatcatttggagcactggctcaggagtcgaaatcaccaatggctcatccatcaatcaaccagaagtgaagacgaaagcttcaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggggaatgataatctggtttattttttctgtaaacttaagtttccgttgacttctgtacatctacaatgaatacctcctcatagaagtggtgtctttacataattttttgtgtaggtgacactatgg

SEQ ID NO: 3713 - DNA, 2075 bp, Homo sapiens
atgcttgggaaggacatggtcagatttgttgtaagaaagactgtgcagaggagtgtggcaaagggatccagaagatgcaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggggaatgataatctggtttattttttctgtaaacttaagtttccgttgacttctgtacatctacaatgaatacctcctcatagaagtggtgtctttacataattttttgtgtaggtgacactatgg

SEQ ID NO: 3714 - DNA, 1423 bp, Homo sapiens
gcccaaggatcactcatgcttccaggctgcacagagcactgttggatctagctgaacgaattgttttctctgtctctgggtatcaacggtttctgtacagcacagattatgacagcgtctttcttaagagacaagttctcactacgttgcccaggctggtgtcaagctccgggcctcaagcgatcctcccacctcagcctcccaaagcgctgaaattacagacgaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaac

SEQ ID NO: 3715 - DNA, 1523 bp, Homo sapiens
ggtatcaacggtttctgtacagcacagattatgacagcgtctttcttaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaa

SEQ ID NO: 3716 - DNA, 2297 bp, Homo sapiens
atttagaaagattttataaatatgatcctaatgcagttagatggaaaatggcaagttattacagagaatactttttattttacttttatcagcaagaaaccagtgggttgtattagtaatattagactttcttttttccagggtatcaacggtttctgtacagcacagattatgacagcgtctttcttaagcagatggaatcttggaacgtctcatgcttgggaaggacatggtcagatttgttgtaagaaagactgtgcagaggagtgtggcaaagggatccagaagatgcaaggtattatttagaaaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggggaatgataatctggtttattttttctgtaaacttaagtttccgttgacttctgtacatctacaatgaatacctcctcatagaagtggtgtctttacataattttttgtgtaggtga

SEQ ID NO: 3717 - DNA, 2278 bp, Homo sapiens
gtcctatttctttcctccttttcctcgaataagcattcgtatgcagatgacgggggccttcaaaagaactggagatcagccagatcacttgtatgcacaaagctgctgtggatctgtctttcaaacaagagctgcagaaaacgctatagcaaggttgaagctttatccactctgactcacccagaaagcacagccctgattctgcgtgagaaaggctatctctacagaaactaaaacggtatcaacggtttctgtacagcacagattatgacagcgtctttcttaagaagagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaagggtaatatgaaagattttaaatgaaaaaaatttgttggatgatgatttttgaaaaatagtcaccaactgtatatacttcctcaagaactgataattcattatatcatcagatagcttttattaagcatctgtgggaatatacagttgggggaatgataatctggtttattttttctgtaaacttaagtttccgttgacttctgtacatctacaatgaatacctcctcatagaagtggtgtctttacataattttttgtgtaggtga

SEQ ID NO: 3718 - DNA, 1922 bp, Homo sapiens
cagcaagaaaccagtgggttgtattagtaatattagactttcttttttccagggtatcaacggtttctgtacagcacagattatgacagcgtctttcttaagatggaatcttggaacgtctcatgcttgggaaggacatggtcagatttgttgtaagaaagactgtgcagaggagtgtggcaaagggatccagaagatgcaagaagagaatgtttaaatttcatcaaatgaaacatatttttgaaatacttgataaaatgagatgcctgagaaaacgttctacagtgtcattcttgggagttcttgtcatttttctcctttttatgaacttgtacattgaagatagctatgttctggaaggagacaaacaacttataagggaaacatccacacatcaactgaattcagaacgctatgttcatactttcaaggatttatctaatttctcaggagccataaatgtcacctatcgctacctagctgccacacctttacaaagaaagcggtatcttacaattggactttcttcagtaaagcgaaaaaaaggaaactatttacttgagacaattaagtcaatttttgagcaatccagctatgaagagctgaaggaaatttcagtggtggttcacctagcagactttaattcttcctggcgtgatgccatggtccaggatattacacagaaatttgcgcaccatattattgcaggaagattaatggttatacatgctccagaggagtattacccaatcctagatggccttaaaagaaattacaatgatccagaagatagagtcaaatttcgttccaagcaaaatgtagattatgcttttctgcttaatttttgtgccaatacttcagactattatgtaatgcttgaagatgatgttcgatgttcaaaaaatttcttaactgccatcaagaaagtcattgcatccctagaaggaacttactgggtaactcttgaattctctaagcttggctacattggtaaactctatcattctcatgatctcccacgtttggcccattttttattaatgttttatcaagaaatgccttgtgattggctattgactcatttccgtggtctgttggctcagaaaaatgtgatccgttttaaaccatctctctttcagcacatgggctattattcatcatacaaagggacggagaataagctgaaggatgatgattttgaagaggagtcatttgacattcctgataacccccctgcaagtctgtacaccaacatgaatgtgtttgaaaattatgaagcaagcaaggcttacagtagtgttgatgagtacttttgggggaaaccaccttcaacaggagatgtttttgtgattgtatttgaaaatccaattataataaaaaaaattaaagtaaatactggaacagaagatcggcaaaatgatattttgcatcatggagccctagatgttggggaaaacgttatgcctagcaaacaaaggagacaatgttctacttacttaagactaggagaattcaaaaatggaaactttgaaatgtcaggtgtaaatcaaaaaattccatttgatatacattgtatgaggatatatgtcaccaaaacacaaaaggaatggctaattattaggagtattagcatttggacttcttagccaattaaatcagtatgttcagtttctgaagcagttcttcctgcttcgtcttttgctacctttgtcttttggagggaaagcaatggatgggatatgttaaaagaaacattaattacattggcagttttcatttatacattgttgacataattttactcttaatacacacttgtatttattttaacgtctgaagttgaatatcagtctatagctaatgctactttcatttatatttttaaatgttcttagttttaaaatttcaactgattgtcgaaa

SEQ ID NO: 3719 - DNA, 2895 bp, Homo sapiens
acttccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactcta

SEQ ID NO: 3720 - DNA, 2568 bp, Homo sapiens
acttccggcgggaggcggaggcggaggcgcaggcgctggctggcaggtgtcgctaaccggacggtggtcgccagggcgagaggcgggagccggagagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactct

SEQ ID NO: 3721 - DNA, 981 bp, Homo sapiens
gtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcaggtaactgggggaaaagaatgttgggggatggaaggggtggttattcccattttcaccagtctccatgtcccctgcctgagacctcccaacctgactcctgaacactttgtatttctctttataatgcccactgccttctcttgaataatatttcctatttatcttctccccttcaagctacaatgtcttctggacctccaacccaggactgcccctgctgacagagatggtaaagagtcgcctaaatagctggtttcagcatcggcccccaggggccccccctgaacgctacctcggcttgccaggatccctgaagt

SEQ ID NO: 3722 - DNA, 2623 bp, Homo sapiens
ttttaacttgcgcgggccgcgaggcaaggctcacctgcagaccctcgggccaccagcagggaggcacgcactccccctcgcagcgcgcccagcccggggtcagcggtgtggctgagctgggggggagcgcggggcggtggggggagccacctccctgcggggctcagcgctggggccgggagcccggagcctccgcggggagggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctttgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactca

SEQ ID NO: 3723 - DNA, 496 bp, Homo sapiens
acaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagatttttgtgtggacataagttttcaattcatttgagtgaatacataggaggacaattgctgaattgtatgagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatactt

SEQ ID NO: 3724 - DNA, 2504 bp, Homo sapiens
ctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagagttcagaaggaacagctggctgccatcttcaagctcatgaaagacaacaaggagacgtttggcgagatgtccgacggcgacgtgcaggagcagctccggctctacgacatgtagactgcgcccacgggatgcacagcggccatgcctgatgctgtccccacccttgccccatgcccttgttctttccagacttctgtaggcctaattttcccttataaacatagatgcaggcgtacattctataggtacttgccgagttcttgcagtgtgtatattactttgcaggaatcaaaattgttttattcagaagacaaagtccctgacccctctggtttctgcttgctggtgaggttccagctgttattgggctctgaggccctctcctgatccaaatctttttttgtttgtttgagatggagtctcactctgtctcccaggctggagtgcagtggcgtgatcttggctcactgcaacctccacctccctgattcaagcgactctcctgcctcagcctcccgagtagctgggattgcaggcatgcaccatcacacctggctaattttgtattttcagtagagacagcgttttgccatgctggccaggctcgtctcgaactcctgacctcaggtgatccgcccaccttggcctcccaaagtgctgggattacacgcgtgagccaccatgcccggccaatactacactcttattctgccttacgaggatttctggaagcttctgtaactgtagggaagaaagctgtaggggagcatggtttttttgttttgtttttgtttttgagacgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctgtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaaagtggagcagtggcatttccatgcctcatgctcaccatcatgaggttaacttcccgccgtcgcctcttgcctgccaggggtttttcgggagcccctctctgttccactctgattccttttgtttcttgctgaccattcactctctgtgtctgttgttggatccaaatacgagtgtttttctttc

SEQ ID NO: 3725 - DNA, 1918 bp, Homo sapiens
ctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggattgagctgacctctgacctcacttccctgtagcaagttccttaggtcctgagccacaaatattcttgcaaatccttttgaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctc

SEQ ID NO: 3726 - DNA, 569 bp, Homo sapiens
cggggcgcggcgggctccctcggggtcccagctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagaggacacagcgg

SEQ ID NO: 3727 - DNA, 1837 bp, Homo sapiens
ctggcccgcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctc

SEQ ID NO: 3728 - DNA, 2273 bp, Homo sapiens
gtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttta

SEQ ID NO: 3729 - DNA, 1974 bp, Homo sapiens
gccgagtgggacaaagcctggggctgggcgggggccatggcgctgccatcccgaatcctgctttggaaacttgtgcttctgcagagctctgctgttctcctgcactcagcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 3730 - DNA, 2625 bp, Homo sapiens
aagaaggctggcggtgtttcctcttagaggggagaaactcagcctgggtaggagacccagccccacgcagggaaaactgtgctaacgcttccgatgtgcgtggcaggtgcggcggcggcgaatacggtttgtcctcgagcctaaccctgtctgtgttggtgtcagcagtggcccccctaccacacacacagggtccctggcgtcccaagaccactcctggcagccccgccactggctgcgcctggaagccgcgtcctcaggcctcgcctggcatttgctgtcacagaggttgcttccttgggtccgtccgtcctcgcccctccagcctgggcgccccccgacccctgtctcattccctccaccacatgcagcacagtccaggaggctggggtccaagagggccatggctggcacccggcttagtgctgagtccccagtgcccagcaagcctggcacccaggaggtggtcagcaaacgcttctgaacgacaggaagtgggactcttcagccatcgatgatccgctgtgcggccacaggctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagattacaaaaacaacatcctgaaggagagggcggagctggcccacagccccctgcctgccaagtacatcgacctagacaaagggttccggaaggagaactgcaaatagggaggccctgggctcctggctgggccagcagctgcacctctcctgtctgtgctcctcggggcatctcctgatgctccggggctcaccccccttccagcggctggtcccgctttcctggaatttggcctgggcgtatgcagaggccgcctccacacccctctcccaggggcttggtggcagcatagcccccacccctgcggcctttgctcacgggtggccctgcccacccctggcacaaccaaaatcccactgatgcccatcatgccctcagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 3731 - DNA, 2001 bp, Homo sapiens
agagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagcctcctctcctcccacagattacaaaaacaacatcctgaaggagagggcggagctggcccacagccccctgcctgccaagtacatcgacctagacaaagacccttctgggctctgcccgctgggggcctgaagacattcctggaggacactcccatcagaacctggcagccccaaaactggggtcagcctcagggcaggagtcccactcctccagggctctgctcgtcgggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccttgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgattttt

SEQ ID NO: 3732 - DNA, 864 bp, Homo sapiens
gttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaaga

SEQ ID NO: 3733 - DNA, 1107 bp, Homo sapiens
gggcggggctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 3734 - DNA, 2153 bp, Homo sapiens
ctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgca

SEQ ID NO: 3735 - DNA, 1708 bp, Homo sapiens
gagagaagcgaggtttccattctgagggacggcgtagagttcggccgaaggaacctgacccaggctctgtgaggaggcaaggttttcaggggacaggccaacccagaggacaggattccctggaggccacagaggagcaccaaggagaagatctgcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtccagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgtt

SEQ ID NO: 3736 - DNA, 6861 bp, Homo sapiens
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaa

SEQ ID NO: 3737 - DNA, 6800 bp, Homo sapiens
gggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcgtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacgggaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcccgggggctgcgccggcgtttgccggcccgggcggcggcggcagcggcgcgctggaggccgagggcagggcgggtgcgcgcgcgggtccccggccgggcccgcgacccccggggggcgccccggcgcgcaaggccgccgtcgcgccggggccctggaaggtgccgggttctgacaagctgcccagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattaattagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaa

SEQ ID NO: 3738 - DNA, 2013 bp, Homo sapiens
aaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtaagacaaacactggctcagcaataaaatatgtgggtaaaatagtaggatcatttaataatattgttaaaatgcagatttccttggagttgaatgaaattatactttaaaaaataaagcttaaagagtgagagagaaaaacatgaattaaagg

SEQ ID NO: 3739 - DNA, 3762 bp, Homo sapiens
atgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcggaagtgaaagcaaggcaagatgtgaaaccagacatccgacagcctccattcacagactacaggcagcccccgctggattacaggcaacccccaggaggggactaccagcagcccccacccttggactacaggcagcctcccctactggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacccgcccgccccggcgcaggcagttcttcttaggttccgtctcacggcgttttaa

SEQ ID NO: 3740 - DNA, 2348 bp, Homo sapiens
aaaagtgagagacaggcgcgtagataacacaggttcttgtgctgagagatgtaaatgcccctgactgaccgggaagcgagcgaggttgctggtgggggttggggaaagggaaacggagggagagagcataagcgagagaggggagaaggagagagagggagagggagagagggagaggcagagggagacagagagagagagagagaagtgctgcatgcttcatctttgagaggagggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacggagtctcgctctgtcgcccaggctggagtgcagtggcatgatctcggctcaccgcaacctctgcctcccagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtaagacaaacactggctcagcaataaaatatgtgggtaaaatagtaggatcatttaataatattgttaaaatgcagatttccttggagttgaatgaaattatactttaaaaaataaagcttaaagagtgagagagaaaaacatgaattaaaggaaactttgtttttgaattc

SEQ ID NO: 3741 - DNA, 2529 bp, Homo sapiens
gttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 3742 - DNA, 2392 bp, Homo sapiens
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 3743 - DNA, 1797 bp, Homo sapiens
cccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaa

SEQ ID NO: 3744 - DNA, 876 bp, Homo sapiens
cggcggcagggtctctgcgggctggcgggtgcggggcggccccggaggcgcgttggaactcggggctggcgcaaccgcctgtggctctgccggggatgcgctgggaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgc

SEQ ID NO: 3745 - DNA, 2471 bp, Homo sapiens
taaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccagagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaaggc

SEQ ID NO: 3746 - DNA, 557 bp, Homo sapiens
agctcaggtgggccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctacc

SEQ ID NO: 3747 - DNA, 2280 bp, Homo sapiens
actctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgccaccggacaatcgagaccacttcccatccaggcctcttcccctttccatctgctttttcagcttctccatcgcctgccttctgaccttttccttgattcaacaaaaatgtactgagcatctattcatgtggcaggcccctgtcctaggcc

SEQ ID NO: 3748 - DNA, 3917 bp, Homo sapiens
actctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgccaccggacaatcgagaccacttcccatccaggcctcttcccctttccatctgctttttcagcttctccatcgcctgccttctgaccttttccttgattcaacaaaaatgtactgagcatctattcatgtggcaggcccctgtcctaggccctagggatccaactggctgtctgcctctagaactctccaccctcatctctctgcgtatttctccctgaaatggggtctggtccttggtctctgccactgccctgcctctcctctggccctgggaacaggaggtgccctgtgtgtccgtctctcgaagttctgcctctctgtgcccagctcaagtctctctccccctcctttctccccctaaactttggccggccgccgggcgacaccacgagttatttcccagctatttcccggtccgggagctcttggcccctgaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctc

SEQ ID NO: 3749 - DNA, 3738 bp, Homo sapiens
ctctacgcaggcccccgtccctctgccccaccctgttctcgccactggccctgcccccatttgccggcgcccttcctcttcgcttccccgtagctcccgctttcgcctcttcgtttatgactccgttgggctccggccctcctagagaggcctccatagcgcaggttcgtgggttctcgcggacctttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcatcgttcttatatgcgattaacagaaaaagaagatgaatcactgccaatagatatagttcttcagacacttctggcctttgcagttacctgttacggtatagttcatattgcaggagagtttaaagacatggatgccacttcagaactgaaaaataagacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctcaccctgtt

SEQ ID NO: 3750 - DNA, 3537 bp, Homo sapiens
atgactccgttgggctccggccctcctagagaggcctccatagcgcagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcatcgttcttatatgcgattaacagaaaaagaagatgaatcactgccaatagatatagttcttcagacacttctggcctttgcagttacctgttacggtatagttcatattgcaggagagtttaaagacatggatgccacttcagaactgaaaaataagacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctc

SEQ ID NO: 3751 - DNA, 2910 bp, Homo sapiens
ggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattggaattttgttaatcttactgatcatcagcatagcagagctcagcatctctgtgactattgcatcctttagaagcaagtgctggacacagtcagatgaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 3752 - DNA, 808 bp, Homo sapiens
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaattttttttatcattgcaggagtcttcctaataagagtaacaaagtatccgactcgatctggaaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 3753 - DNA, 928 bp, Homo sapiens
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaattttttttatcattgcaggagtcttcctaataagagtaacaaagtatccgactcgatctggaattataagtactttaatcataaacatcatctgcataattactacaattactgcagtaactctaacaataatagagttgtctcattttaattctgtgtcatacaggaattatggacaagcaaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 3754 - DNA, 751 bp, Homo sapiens
gagccggccgggtgctgggctcctggctatccctgtgatggtagctcagcgagatctggggacctggcgctgagcgcgttgccagccgggatcttcctcttcatctaggcctgggcgctggcgtgagaactcggactgggtcctggacgagcgccccccgaaactccttggaaccttgaacaagtaaaatgcaggaagtttgctaataaagacatcaccaaaggttaaagagaaaatcatctagaggaaatgctggcagtatggcatgtgttctttaacaaatctctacagcagattctctcgttttagggactatccagattatgattggcatctttcacattttcatgtggtactttctattggttttgtatatgggacaaattaaaggagcctttggaacgtatgaacctgtaacttacaaaacaggatgtactttatggggaatttttaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaa

SEQ ID NO: 3755 - DNA, 2997 bp, Homo sapiens
catctattctttgtttaccatatgtttgtaagcaaattgacaagagagtaagtcttctggatacagtacttttcaccaggaagatggggggctgagcatgctctagaattctaaaactctgtgactcaactatgattctgagattctactactgagtagagtcatcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 3756 - DNA, 1518 bp, Homo sapiens
ggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgacttcatccttctcactcctccacactccagccacttcctataatcccttaatgtgtcaagtatccacggccccaagatgatcagaggatcagcttcttccggctttgaaccgtcaccaggttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaacc

SEQ ID NO: 3757 - DNA, 2813 bp, Homo sapiens
gattctgagattctactactgagtagagtcatcactaagggctcatctctgagggctccatgtgactctggtggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttattggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 3758 - DNA, 2537 bp, Homo sapiens
ggaagtctcagaggctggagagcagagcaccaagatcgttctggcaggaacagccagtgggaggttccagctgagcgctccccagaggtgagctgatccccagccacagcacacaggaccaggctgcgagaacagggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaaaatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaaaaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatggacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaa

SEQ ID NO: 3759 - DNA, 1536 bp, Homo sapiens
atcgccttgaagttacgcttgaaggaggaaaactcatcaattttcggggaatcccggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaatttt

SEQ ID NO: 3760 - DNA, 1818 bp, Homo sapiens
cttgaagttacgcttgaaggaggaaaactcatcaattttcggggaatcccgcctttgtttcccaggctctctgagcacgatgtctgcagctcccgccagcaatggagtgtttgttgtcatcccgccaaacaacgccagtggcctctgcccacctccggccattctgcccacatccatgtgccaacctccagggattatgcagtttgaggagccaccgctgggggcacagacaccaagggccacacagccacctgacttgcggcccgtggagacattcctgacaggagagcccaaagttttggggacggtgcagatcctcatcggcctcatccacctaggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaatttt

SEQ ID NO: 3761 - DNA, 3162 bp, Homo sapiens
atggaggtgagcggggaccccggcatccccgccctgcaccgcctctgcacccgggcgctcagtgctagtcctggacccactgcccttggccccagcaccttcctgccctgggacgtctcagccaggatgaccagtgcacgccgccgcacagacgtgggccccagagtggctttcacctacccgtgcacacagctgtcacctacccgtgcacaccgtcacctacccgtgcacaccgtcacctacccgtgcacacagctgtcacctacccgtgcacacagctgtcacctacccatgcacactgtaacctacccgtgcacaccatcacctacacgtgcacacagctgtcacctacctgtgcacactgtcacctacacgtgcacactgtcacctacacatgcgtgcctgcacgcatccacagtctcatgcctgtgctgtatacccgtgcacactgtcacctacccgtgcacactgtcacctacatgtgcacactgtcacctacacatgcgtgcccgcacgcatccacagcctcatgcctgtgctgtatacctgtgcatactgtcacctacccgtgcacactgtcacttacacgtgcacactgtcacctacatgtgcgtgcctgcatgcacccacagcatcacgcctgtgcatgctccaccagacacgtcctgcgcttgggcccaggctgtgcacaggtggccagtgctgtggggctccagaagttcctccatgtcctctggcctcaagcagacccccatggtgggggtcacaggtccaccctgggacccggatgccccggcccctgctcccgccgggaccctcacagcccaccttattccaggtgccctgcagagctcaggcctcaccctcctgctgtcccttgctgcccactgctctgggccccaggccaaggttctttccccaggagggctggatgccagcggggccaacctgtgggccagtgccaactgctccctgctgcaaggcttctggtgccagccggccagccagctgccccgggaccagctctcagccctaatccagaggctggccttgctgcaggtccccctccaggcctggcaggtgagcgggaaggagtgcagaggggcaggcacgggtggccgtggggatgacccgacatgtgggaaacggggccgagaagtgggtggggactggggcctgaggcctccgcagaggggaagggcgcccacgggctgccacggcgagtccagagtcacgagggagcgccgttctgcccagctcagctgcttggccaacctggcgtcacggtgcggcctccaggacgacttcacgctccacccacccaacctgctgctcttctacaacctgagccaggtgcgggaagccgactgccgggccttcatccgccgtgccgcccagggggacgtggagctgctgagccatctacccgaccagagggtcgccctgtggcgtgcggctgtggcctgcctggtgggcgctgggtggggatgggcccggtgcattggaggcagcctcccgctgggcgccgacctgctggccctgcagggggtggcccgcctgcgactcagcgcctccgaccagcaactgctcggggccctggtgtgtgacatggacgcgtccagcatcggtgccgcagacccccacatgctggagaacctgcggcgctgcccccggctgaccgctgcccagcgcattgcccttaactcactgctggccggtgggaagacctcgctcgggccccctggctcctggacactggaggggctacaggccctggggcccctggccacatacatcagccctcacctgtgggcgcaggtgcaggaggccgtgggcctgggcttcttccgcagcgtggtggcttcgtgccaggtgggaaggctcggccagcgcgaggccaggtgcttcgtcaccagcttcctggagtccaagaccaaaccagtgtcctccaggcccaggctcagcacaggcaacatcacggccgccacgctgcgggacgacctcttcctggtgcactacgactgtgcagagcttgagtcctgcctggatggctgcatcctcagaaccaacctggacaccctgttgcagcacctgctgcccactgagtgccagcatgtggtcaaggccaagctcgcacagatctacccacaaggcctcccggaggatcagctgcggctcatcacctcgctggtctacctctactcccgcaccgagatcggccagtggagcatcacctcccaggacacggtcatggctctgctggcctccgacgtggccctggagaaccagacagaggctgtgctgcagaagtttctggagcacaatggcacagtctccggtgccctgctgctggccatcgggggcacccgcctgtgctggatgagtcctcaccagatccagaccatccatccccaggagctccggctggccggggccctggacctctcctcctgcccccagagccggaaggacgtgctctacaccaaggcccatgagaccttcggcagcagcgggaccctagctgcctactaccgcctcatgcgcccctacctcggcggctcccctggtggagcccagcccccctcacccgtccccccaggcggcgccccggtggaggagctgcggcacctggcccacgccaacatctccatggacatcgacaccttcaccagcctgaaccccctcgagctgcagagcctggatgttggcaacgtgactgcgctgctgggccacaacgtgggagaccttcagaaggcccgcagccaccccaccgtcagggcctggctgcgcagcctcaacagctccaccctgggccagctcggcctggacgccagccccaccagccccactggcccagcccacggcaccagggggccccccagcaccacccaccaagtgctccatctggtccacacctcgggcctgcccacgaacgatgcccaggcctccacctcaggcagcctgtgggcccccctggggtacctgcccctggcgatggccctgccttgcagcctcctgtgcctgctgcactgggggacttgcatcctggtttctgtggacagcgttgcctcagggtggctgggttcacaggggtcaggtgcaggaaaaacagaggtgttagattcagctggacgcccacttgggctgacgggccagctctag

SEQ ID NO: 3762 - DNA, 2109 bp, Homo sapiens
atggccgcagccgtcaccattcctggcccccgcattggtgccctgcagagctcaggcctcaccctcctgctgtcccttgctgcccactgctctgggccccaggccaaggttctttccccaggagggctggatgccagcggggccaacctgtgggccagtgccaactgctccctgctgcaaggcttctggtgccagccggccagccagctgccccgggaccagctctcagccctaatccagaggctggccttgctgcaggtccccctccaggcctggcagctcagctgcttggccaacctggcgtcacggtgcggcctccaggacgacttcacgctccacccacccaacctgctgctcttctacaacctgagccaggtgcgggaagccgactgccgggccttcatccgccgtgccgcccagggggacgtggagctgctgagccatctacccgaccagagggtcgccctgtggcgtgcggctgtggcctgcctggtgggcgctggcctgcgactcagcgcctccgaccagcaactgctcggggccctggtgtgtgacatggacgcgtccagcatcggtgccgcagacccccacatgctggagaacctgcggcgctgcccccggctgaccgctgcccagcgcattgcccttaactcactgctggccggtgggaagacctcgctcgggccccctggctcctggacactggaggggctacaggccctggggcccctggccacatacatcagccctcacctgtgggcgcaggtgcaggaggccgtgggcctgggcttcttccgcagcgtggtggcttcgtgccaggtgggaaggctcggccagcgcgaggccaggtgcttcgtcaccagcttcctggagtccaagaccaaaccagtgtcctccaggcccaggctcagcacaggcaacatcacggccgccacgctgcgggacgacctcttcctggtgcactacgactgtgcagagcttgagtcctgcctggatggctgcatcctcagaaccaacctggacaccctgttgcagcacctgctgcccactgagtgccagcatgtggtcaaggccaagctcgcacagatctacccacaaggcctcccggaggatcagctgcggctcatcacctcgctggtctacctctactcccgcaccgagatcggccagtggagcatcacctcccaggacacggtcatggctctgctggcctccgacgtggccctggagaaccagacagaggctgtgctgcagaagtttctggagcacaatggcacagtctccggtgccctgctgctggccatcgggggcacccgcctgtgctggatgagtcctcaccagatccagaccatccatccccaggagctccggctggccggggccctggacctctcctcctgcccccagagccggaaggacgtgctctacaccaaggcccatgagaccttcggcagcagcgggaccctagctgcctactaccgcctcatgcgcccctacctcggcggctcccctggtggagcccagcccccctcacccgtccccccaggcggcgccccggtggaggagctgcggcacctggcccacgccaacatctccatggacatcgacaccttcaccagcctgaaccccctcgagctgcagagcctggatgttggcaacgtgactgcgctgctgggccacaacgtgggagaccttcagaaggcccgcagccaccccaccgtcagggcctggctgcgcagcctcaacagctccaccctgggccagctcggcctggacgccagccccaccagccccactggcccagcccacggcaccagggggccccccagcaccacccaccaagtgctccatctggtccacacctcgggcctgcccacgaacgatgcccaggcctccacctcaggcagcctgtgggcccccctggggtacctgcccctggcgatggccctgccttgcagcctcctgtgcctgctgcactgggggacttgcatcctggtttctgtggacagcgttgcctcagggtggctgggttcacaggggtcaggtgcaggaaaaacagaggtgttagattcagctggacgcccacttgggctgacgggccagctctag

SEQ ID NO: 3763 - DNA, 1364 bp, Homo sapiens
tgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggcaa

SEQ ID NO: 3764 - DNA, 1521 bp, Homo sapiens
gcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcaggctggagtgcagtggcacaacctgggctcactgcaacctccgcttcccgggttcaagcgattctcctgccttagcctcccgagtagttgggattacaggcgcccgccaccacgcccgcgcggattcatggaaaatttttaaatctgcatgtactttaaagaaatacttttgagtcggtggactgaacatgactgatgtatatagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttct

SEQ ID NO: 3765 - DNA, 498 bp, Homo sapiens
gtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagcaaatcttatcaagtcgtgcaggaacccatatgttaagaaaatga

SEQ ID NO: 3766 - DNA, 766 bp, Homo sapiens
aaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggagaaggttaa

SEQ ID NO: 3767 - DNA, 1655 bp, Homo sapiens
gtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggctacaattctgttctgaatgtgcactcctaatttatttgatttaatttattcaatttattaacttagttttcttagaccaggctgaatacctaatatgtggctttttggctgaggctttttacttctgtttagaaatttgatgcctattttaggaaccagaaaaagataaattgcttcagtagaagagaccatatttaactttaaaaagtgaggaggaatgtgctttttaattatgctctcataagtctaatcttttgggggtttagtagcacatagataaatattaaaggtggttacatataataacatctgataatactcatttcagtataacattggtctttgctgatgtgttcgatataggttaggaagagttcttttagtttacttgggcaaatgtggcagttttagacctatgtctttgtagtacatcttcagttgtctttcttgtattaattccagaag

SEQ ID NO: 3768 - DNA, 1280 bp, Homo sapiens
gtaaaggtcggcccgcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggcatctctccagctggacaagaaacggtagatgcaaatctgcagaaactcacacaacttgtaaataaggaatccaacttgattgaaaagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggct

SEQ ID NO: 3769 - DNA, 4799 bp, Homo sapiens
gcgcaagatggcggcccccttggaactcagttgctggggaggcggctggggactcccatcggttcacagcgagtccctggtggtgatggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggaggcatctctccagctggacaagaaacggtagatgcaaatctgcagaaactcacacaacttgtaaataaggaatccaacttgattgaaaagatggatgacaatcttcgccaaagccctcagcttcctcctcggaaactgccaacacttaaattgactccagcagaagaagaaaataattccttccaacggctttcgccctgagagtagtcatggtttgtggccaaagtcaaacgattgttgcagtaatctcttacaccaagtgtgtgaaggcaaaaagaagataccataataggtattaaggaagactctaaaccaaaaggaactttctatgccatctatttttactattattattaggaagcttgtattctagcttggcactgcatttttaataacaaagagaatgctaaatgaacttggttgggggggcggggaagaaaaacacatcgtactgtatacaaagaactgccttaatcatggcagatttttgcctttggttcacatgttgctgaccaaaggctacaattctgttctgaatgtgcactcctaatttatttgatttaatttattcaatttattaacttagttttcttagaccaggctgaatacctaatatgtggctttttggctgaggctttttacttctgtttagaaatttgatgcctattttaggaaccagaaaaagataaattgcttcagtagaagagaccatatttaactttaaaaagtgaggaggaatgtgctttttaattatgctctcataagtctaatcttttgggggtttagtagcacatagataaatattaaaggtggttacatataataacatctgataatactcatttcagtataacattggtctttgctgatgtgttcgatataggttaggaagagttcttttagtttacttgggcaaatgtggcagttttagacctatgtctttgtagtacatcttcagttgtctttcttgtattaattccagaagaagtgaatgtactggttatcgttactatgctaggctgtaaaattcttactgaaattgcccacttgttagacactactcaggaggagcccatggccagggtagtagaaatactgtgcatctggtccaagttttctatgcttggctcatattctttcataagatgcatattctttcataagatgcatatcatgtagtcaaaagctttctgacaaccaattatttttcatatgtttcacttatagtcgaagaatacaaaggaacaatcagaaatagcagcttttaatgaatattttctatttattggttgctgaactgttaagggatttgctgtgtggtaattttacttataatagaaacttgcttattttagtggttgaggtgcttctgttgtcctaaaactacttctgaggtttttaaaatgtagaaccatgtttttgattagtgtcttaaaagattactgtggtgctcagcaaatcttatcaagtcgtgcaggaacccatatgttaagaaaatgagctttgtagtcaaaagactcatctaatttgagctgagtggagctcagctgtgtttgacccacatcctcccaatttgttctgtatttaggtagttatttatacaagagtctttaagtcattctaaatattttttcttgaaagttttaactaagtgagaaataaggtagtcttcaaaatcttggtcatctgtttggatgagggaaagtacctcatgagttgcacattacttctacaacagggtgtgtgtgtgtgtgtttgtgtgtgtcagtcatcttcaaaggcagattattagattccagcaatctgaaatctattattccagcagtctgaaacctaaatatgttatattggaaatcatgactgtgagactttattgtcctctaggatggatgtatattggagaagggtggttagcacattcatcagacatctgcttatgctgtggtcaaggccagtcatttttaatttatatcagatttatatcagaccctccaaaaagtatttgaaatatattacagttataacgtacaagtacattacatgtatattacaagtatattacatgtaaaacaggacaatttaaaaattttaaattttaaagaattaaaaattttaaaaatttaaattaaaaaaattaaaaatttatagaaccatatcaacactgacagattctaaaattaagtagtaaatttaactccaagtttctccatgggcaaagtcaaaagataatgctaggttatgtcaatttttcttttcaacaaaactgctaatgtctattaggaagaaaaatgtgtttaaagttttacaggaacgtggagctcatgttcttctgatatgtagactttgataaagaagcatactgtaatgttttatgaactgaaattttaatcaaaagaggtcattttagaataacaagtattattcttttttagtagagggaatgactgtcaatatgatttatttgtttttgtgtcatccctactttgaactgctgttagccttacattctcactatagtccataatgcttccagatcaccttttctaagatgcaacatgtgagtttagtgagagtttatatgttgggttacttagttgagctatttatgtataagtaaatgagatgacaggaagctgtaactgagcacaaagtactttagggagcagccacacatacaggaagctcttagaaaagaacttttttttttttttgagacagagtttcactcttgttgcccaggctggagtgcagtagcgcagtctcggctcactgcaacctctacctcctgggttcaagcaagtctcctgtctcagcctcccaagtagctgggattacaggcatgtgccaccatgcccagctaattttgttttttttttagtcgagacggggtttcaccatgttgctcaggctggtcttgaactcctgacctcaagtgattcacctgcctcggcctcccaaagtgctgggattacaggcgtgagccactgcgcccggccaaaaagaacattttgtcaatctgaacagagcacagaacattttttcagactgaacagactgttggaccagcctgtcatgatatgttttagataaagtttgagtgagttcattgggataaatggtccacaatcttaaacagaatactgtgagccaatgccttttggaagtaatggtggaggataatatgattaaagggaacatgcttgtgtttatttttgttggtagtatatgattagaaaaactagataattcccataagatgaagatcttccatgaacaaactaccatcaatcatccatcagattgattttttttttttttttaagtaacactaaagaagctgtaaagaacattgaaggtggtcattccttcaaaactgtgttttgaccacacaaggtgggcattaacaaaccaaatttcaacttaagtttgtttgtattatattgggggtgctgcgagactggagattttataaaagcaagcatttttatttccatttataatttctattcaatattgctagatatattaacatgaaggaatggggaagcttatttcaatcaaagctaaaattttcagaagtctgtaaaaatggaaaaacaccattgaaagaggcagaaacaggtaagggggatagtatcttagaaaacctgttggttaaggcagctgcatgtgataaaagtggtacttgaacttggtagtgtttccttagaacctcctccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaa

SEQ ID NO: 3770 - DNA, 3419 bp, Homo sapiens
atgttgaacactagattgtgctttattttttccgcccaacttcacgtttccatgcaccaaaatgttgatgctataaatattggatgccacgcttacctgacaggcttcttccatcccacctgggcgcgggggctcagagcgagcgcgcgagccgcggctggagcccgcctctcgcggctggagaggactcagccggccgcgggttctgctgcttgcccgggtgccctagccgcttcccagccagggctcccgcagtcagccccgcgcgcgcacgcgcgctcccctcgggcggcctcgacgcctcagggcttcggcagggctgcgactggccggctccagcgggcggggcggcgagcgagtgctcgcggccacgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacagtgatctttgtatctgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtccttggcagtggactctgggcctggccattcttcaggtttctgtcaatccagaaacgcgactttcctggacccctgcggctcttcctcccccgcccacatccagccctccaaggccagtccagaggtgaagtttgaggccctccccccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctttcccttgcgcttgctctccggtacctgttcctcacctgagctcaagggcagggagaggccgggcctctggcagtccacgaaggaagccgtctgccttcggttatgattttaggaacaagtccaacgagggtgttcaagcagttaatggttgtgctaactcttgtttctactgaagcgggttttgcaaagctgacatcccttaaagataacttgggctttcggaagcggcaaggaaatggcacctgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacctaaa

SEQ ID NO: 3771 - DNA, 1396 bp, Homo sapiens
ccctcccggcgcagtcaccggcgcggtctatggctgcgacttctctaatgtctgctttggctgcccggctgctgcagcccgcgcacagctgctcccttcgccttcgccctttccacctcgcggcagttcggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgatt

SEQ ID NO: 3772 - DNA, 1135 bp, Homo sapiens
ctcccggcgcagtcaccggcgcggtctatggctgcgacttctctaatgtctgctttggctgcccggctgctgcagcccgcgcacagctgctcccttcgccttcgccctttccacctcgcggcagttcgagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactca

SEQ ID NO: 3773 - DNA, 4456 bp, Homo sapiens
cggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggtatgaatttctgaaattctgtcttcctatgactcctagttgtgacctaaccagtttttttctcatttaatcaatgtagctattcctatattcagtaacacttacttctatagccttaaatagataattttttttcttctatttttttttttttttttgtagagatggggtcttgctatgttgcctgggctggtattgaactcctggcctcaagcaatcaatcctcttgcctcagcttcccagagggctgggattacaggcctgggccacccacacccaaacagaggtttaaagagctttggagaaaccagcctcgtcctccagtctctttgtttgtttgttttgagactgagtcttgctctgttgcccaggctggagtgcagtggcatgatctcgggtcactgcaacctctgcctctcgggttcaaacaattcttgtgcctcagcctcctgagtagctgggattacaggtgcatgccaccatgcctggctaatttttgtgtttttagtagagatggggtttcatcacattggccaggctggtctcaaactcctgacctcaagtgatccacctgcctcggcctcccaaaatgctaggattacaggcgtgagccactgcacctggcctgtcctacagtcttatatcacaacaggttgtgccaagctaggagcttaatctgtaaaatacttgaggcagggataggtttgtctgttttggcttttggctttcatgcgagcagaagtagctcctgctctaggcagcttgaggcagaaagagaagaaacaattgagttgacctacctccgtcctcgttcttctgccagctggcgttattcttttgatagttctctggagtttaaagaagtttagatagtttgctggagatgtttttgtaagtgacgtatagcttatgtctctaatccatgcctgcttacctagattattaaatgtggagcaagatgaccagacaggattaaattttattgaattacagttacaagtggaaaaaatgactgacttactgcatggagaagtattatgtcaacctgttaaaagctatggaaattaaaatgttcatgtatatacaaaatataaatgacatgtaaggtaaaattacagtgatcaatttacaacaaagaaattaacagtagttttccagcttgtttgattaatcaagcaggtttactcttgaatccatagcatttctacaatttaatttggacaaagttctattccagatcagccaggttttaaaactgaaatgtgttaagggtggattgttagcttccccaggattggtgtggatgataaatactttttttaaaaattaattattattgtttataagacatggattccagctgtctccctggctggagtgcagtggcatgattatagctcactgcagccttgaactcctggacttaaacgatcctcctgcatcagcctctgaaatggctgggactacaggtgtgtgccagcatgcctagctaatttttaaacatttgtttagagatgggtctcactatgttgcccaggctggtcttgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagctctgagattaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagtaggcattaaatcaacatggttggtgttcattaaatgtggattgaagataaaatgactgatcttaagtttcatgaggaataggtttgcttcattgaaactggtttttatcttcccaaatagttttcaatcattcctttaaagtactaggttgattaatattgcaaagttgtaatgtaaaatgtgaccttacctctgtctaacctgtattgttcacatgaatgggagtttgactttgggaataaacattgaaaatttgcagggaggaccca

SEQ ID NO: 3774 - DNA, 2269 bp, Homo sapiens
agctctcgcaggccaataacgacaggacgggccgcctggcccacccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaat

SEQ ID NO: 3775 - DNA, 1789 bp, Homo sapiens
aggcgaggcaggttccgaggttggaacacctggcgagtcctcggtgtcggtggccggcagtcatctcgcggccgttcaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtat

SEQ ID NO: 3776 - DNA, 482 bp, Homo sapiens
gaaggtgggcctaggctaaggtacgtgctagaaaggatgaaaacggagtgaaattcttaagtgatggaactaggctagggcatgtttcttgccctttaaaatgtgttgtcttcgggagacaggacgtagaagatagttgcagcacagggtgataggctggcgaaagttatacaaaagcaggaaccactagaaggagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaag

SEQ ID NO: 3777 - DNA, 973 bp, Homo sapiens
ccggctccacccccaagccaggcgaggcaggttccgaggttggaacacctggcgagtcctcggtgtcggtggccggcagtcatctcgcggccgttcaggtgagggggttggaggagtggctcatgagcgaggaagggggagcaggcgggctcccacccggtgctccgtgagatcgaggggagcgggttctgggtgcggatgcacgcgctgggcgggacgctggcagtggtacccgagacggggcggaaggagactggagtgaaggtgggcctaggctaagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgttt

SEQ ID NO: 3778 - DNA, 2037 bp, Homo sapiens
ggcctttcggagggtggtgagctagtctgcggacgctgtataccctcctccacttcccgctgcagccaataaaggccgttcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagatggccgcgctgcgtcgaatgctccacttgccgagcctgatgatggggacgtgccgcccctttgcgggctcactggctgatagttgcctggcggaccgctgtctctgggatcggctgcatgcccagcctcgtttgggcactgtccccaccttcgactggttctttggatacgacgaagtccaggggctcctactgccattgctgcaggaggcacaggctgccagtcctctgcgagtgctggatgtgggctgtgggacttccagcctatgtacaggcctctacaccaaatctccacacccagtggatgtgctgggggtggacttttctcctgtggctgtggcccacatgaatagcctcctggagggtggcccaggccaaacacctctatgccctggacaccctgcctcaagcctccacttcatgcacgccgatgctcagaacctgggggctgtggcttcttcaggctctttccaactactgctggacaaaggcacatgggatgctgttgcccggggaggtctgcctagggcttaccagcttctatcagaatgcttgagggttctaaaccctcaggggaccctgattcagttctcagatgaggaccctgatgtgcgactgccctgcctggaacaagggtcctatggctggactgtgactgtgcaggagctaggcccgttcaggggcatcacctactttgcttacttgattcaaggctctcattaaagacattttagtagtcctgaccctagtatttctgtgggcaaggagagggctgaagaactgtctttgcaagctatctggctgcaaagtgagaatttgagtcctggcttccacatttactagctgggtgccatattgctgaatgtttctgttccccagtttactcatctgcagagtgagaataacttggagttacggagattacatacaatgatgtgcgcaatatttagcacaaaatgaatgctgaaaagagaaggtacaattgggtcattccccagtttcaactaactggagctcctaaaagcagcagacaggaactgaatcaaaacccctgcgctgactgacttgtataatctagtggcctaacctgtaagcctcatttttgtcacctgtaaaaggagattgtaagaggatgggtataaggagcttcataaacctggatgagatatttgagggggagggaacaatacttaccctcaaagctattaggaggcaggagatgggaatattccacaaagccacttctacaaacacgggagcctgttgagtcccagaagggacagtggttggtggcttccagacatgctgtgtcctcaagaatccaacaagcatcttcttcatcctggtcctgcccccagctgagtccagcgttaaatgttcttaaaggacttctagggtcctgtgggctccaagcccagcctgggatggaggaagagaggggacaaaaatattactgatatattatcaaattacaaaactaggccaggcatgctggctcatacctataatcacagcactttgggaggccaaggtgggcagattgcttgagccctggcaataaagtgacacccctaactctacaaaaacaaatgagcccgggatagtggcacaggcatgtagttccaactactcaggaggctgagctgggaggactgcttgaaccctgggaggtcaaagctgcaatgggccatgataagctgctgcacttgagctaaaaattaatttctgtggtattttttgcttataaaaaaatagagcaattatatcactaagagcctaa

SEQ ID NO: 3779 - DNA, 1103 bp, Homo sapiens
gggccggggccgcccgcccccgcgtcgcgggctctttaaggccggcggttttcgcagccagcccggggcggggaaagcggagcgcgcgctccacgcgggaccgcctcccgggccgtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgata

SEQ ID NO: 3780 - DNA, 4805 bp, Homo sapiens
gcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaagtctttaaatgagtaagctttcttggtaagattaaatcttacaaattatttttaaaaccttgtgatatatacaatgtttagctgagttttctaattttctggatgtaaaacaaaaggtttaacctatacattccttgagctgttagtgctatttaaatcttttgccctgtttaggtcctaaacacttttagttgagtaggatatgagcttttttgggtctcatatcatgctttttgccttaatttcaggtatatatatatatataaataaaggaattaagtaaaaataaaatttcagttactttttaaaagcacctgaaatctggccggatgcggtggctcatgcctgtaatcccaccactttgggaggccgaggcgggcagatcacctgaggtcaggagttcaagaccagcctggccaacatggtgaaaccccatctctactaaaaatacaaaaattagccgggcgtggtgtcaggcgcctgtaatcccagctactcaggaggctgaggcaggagaatcgcttgaacctgggaggcagaggttgcagtgagctgagattgcaccattgtactccagcctgggggacaagagcgagactccatctcaaaaaaaaaaaaaaaaaaaaaaaaaaaaagcacctgaaatcttgaataggttttctttttttttttttttttttaattaatttattttttttttattgatcattcttgggtgtttctcgcagagggggatttggcagggtcataggacaatagtggagggaaggtcagcagataaacaagtgaacaaaggtctctggttttcctaggcagaggaccctgcggccttggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcgtggcccatccccaatgagccgctgggcacacctcccagacggggtcgtggccgggcagaggggctcctcacttcccagtaggggcggccgggcagaagcgcccctcacctcccggatggggcggctggccgggcggggggctgacccccccaccaccctcccggacggggcggctggccaggcagaggggctcctcacttcccagtagggacggccgggcagacgcgcccctcacctcctggatagggcggctggctgggcggggggctgtcccccccacctccctcccggacggggcggctggccgggcagaggggtcctcacttcccagtaggggcggccgggcagaggcgcccctcacctcccggacggggcggccggccggaaggggggctgaccccccccacctccctcccggaccgggcggctggccgacccccccccccccccccgcctccctcccggacggggcggctggccgggcagaggggctcctcactttccagtaggggcggccgggcagaggcgcccctcacctcccggacggggcgactggccaggcggggggctgacccccccacctccctcccggatggggcagctggccaggtgggaggatgacccccccacctccctcccgggcggggcggctggccgggcagaggggctcctcacttcccagtaggggcggccgggcagaggcgcccctcacctcccggatggggcggctggccaggcggggggctgatccccccacctccctcccggacggggcggctggccaggcagaggggctcctcacttcccagtaggggcggccgggcagaggagcccctcacctcccggacggggcggctggccgggcggggggctgaccccccccacctccctcccggacggggtggctgctgggcggagacgctcctcacttcccagacggggtggttgccggacggaggggctcctcacttctcagacggggcggttgccaggcagagggtttcctcacttctcagacggagcggccgggcagagacgctccccacctcccagacagggctgcggcccagcagaggcgctcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggcggccaggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaccgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggagagggagagggagggggagggagagggagagggagggaataggttttctatttcaagtcaagagctgaggttttccccttctgttttacccttgctcaaatgtcttaatgcagttctttcccaagctttccctgcttccttaacaacgcataggatgacattaaaagttttaaatctcatccctgcctgagaggttagcttcctacatataagctccttttgtattggacttgtaattgctcattcagtggtagtattgccctgtagagtgtaagctccttgagggccaagaatgcttctgcctcttccattgttgcttccccagtaccttctgtatatttcataaccaaataatgaaaaagatacattccatttaaagggcattgactttgggttaaatgattgttatattgttttaggattatctatgatacactttgacatctcacacacacacatgaacttttctttttacaatgcaaaagtttaaacaatagcttaaatttagactgcaagaatattataatctcaatatggtatttggtactagagatagatttcttttataaaatcttaaaaacaggacgttctcttccttttgaacctttatcccagaggtgaaaatatccaatatgttgttttctgcatatattgaagtagtagtttcactttaataaagatggattaaaagtt

SEQ ID NO: 3781 - DNA, 869 bp, Homo sapiens
cgggccggggccgcccgcccccgcgtcgcgggctctttaaggccggcggttttcgcagccagcccggggcggggaaagcggagcgcgcgctccacgcgggaccgcctcccgggccgtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatat

SEQ ID NO: 3782 - DNA, 1051 bp, Homo sapiens
gattcggaagagccatgcaaaagaaattggacaaaggcttcctccacctgtttctttttttcttttgaacttgtaaacgaccttaaaagcatttggagttagttaagaacagataatgtatcttttggccagagcgtcacccaggattcttttgcacggcaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctg

SEQ ID NO: 3783 - DNA, 1003 bp, Homo sapiens
ctgtgctttagttgaaaagggttttgtgacttttccactcgattgccgccaagcgggctattacgccgcttctgaccccaccgtggagacgcggggactagagtgaccatgccttcttcggagcgagctgtctccatcatccgctaacgcgccacctttaaaaaacaggcacaacgcgcaagcgacaaagtcagaggcagagagcggcggagcacatgatagaaaaggtcgagaggcacattcagcgccaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaa

SEQ ID NO: 3784 - DNA, 1770 bp, Homo sapiens
ccagtgtcgctcacttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggtgctcatgtgactatcacggatcgaaaagtagcattagaatttcttaaatcaaacgttcaagccaacttacctcctcatatccaaactaaaactgttgttaaggagctgacttggggacaaaatttggggagtttttctcctggagaatttgacctgatacttggtgctgatatcatatatttagaagaaacattcacagatcttcttcagacactggaacatctctgtagcaatcactctgtgattcttttagcatgccgaattcgctatgaacgggataacaacttcttagcaatgctggagaggcaatttactgtgagaaaggttcactacgatcctgaaaaagatgtacatatttacgaagcacagaagagaaaccagaaggaggacttataattggctataatttataagaatgttgtcattgagtgtgtcacttaaggtcttagactgcaaatctaaccatatttaatgaaatgtcttactgtacaaaaagtctaagccaaaggttctcaggggagaaagcacatgtgcagttttaaaacaaagcagtgctttgtcccattgctgtgatttttagtcagactttactcagtctgaaatgcaattaacattaaaggattaagtgtgagatttcgatttatgctatttgtgtatcccatactcctcccttttaataaacagtttccactgatgatatgaagggccggtataaagaagtctttaaatgagtaagctttcttggtaagattaaatcttacaaattatttttaaaaccttgtgatatatacaatgtttagctgagttttctaattttctggatgtaaaacaaaaggtttaacctatacattccttgagctgttagtgctatttaaatcttttgccctgtttaggtcctaaacacttttagttgagtaggatatgagcttttttgggtctcatatcatgctttttgccttaatttcaggtatatatatatatataaataaaggaattaagtaaaaataaaatttcagttactttttaaaagcacctgaaatctggccggatgcggtggctcatgcctgtaatcccaccactttgggaggccgaggcgggcagatcacctgaggtcaggagttcaagaccagcctggccaacatggtgaaaccccatctctactaaaaatacaaaaattagccgggcgtggtgtcaggcgcctgtaatcccagctactcaggaggctgaggcaggagaatcgcttgaacctgggaggcagaggttgcagtgagctgagattgcaccattgtactccagcctgggggacaagagcgagactccatctcaaaaaaaaaaaaa

SEQ ID NO: 3785 - DNA, 1366 bp, Homo sapiens
gttttcgcagccagcccggggcggggaaagcggagcgcgcgctccacgcgggaccgcctcccgggccgtaagtaccggcgtggcggcgcctcagcccggcctgggcgagccctgggtgctccgccgggcagctcacggcgccccgtatggcctggggatcctaagaggccctgtgacccccctcgcctggtctccctctcacccctggagggttgccgcagctccggggcccccgggcaggaagggcgcactggtcgtcccgggagaggggtctgagcagagggcggggtgcaggcggaatggccctcgtgccctatgaggagaccacggaatttgggttgcagaaattccacaagcctcttgcaactttttcctttgcaaaccacacgatccagatccggcaggactggagacacctgggagtcgcagcggtggtttgggatgcggccatcgttctttccacatacctggagatgggagctgtggagctcaggggccgctctgccgtggagctgggtgctggcacggggctggtgggcatagtggctgccctgctgggaggtggaatttaattctcctccccttgaatatgggctggacaaagagaaaaatggtagctcaacagtggagacacctggacagcactttaaccaagtgatcaaagttaatatcgccaattatgtatgtgctcccggatgtgatgttatgagaaaggcacactatacctctgtggaattcctccccaaaacctattatctcaatctatccatagaaaacactggacaaatgcaaactgagggatattctaaaagaaaacagatcactactcttcaaaagttacaaggccatcaaagacaaggaaacaaactttcacagactgaaggagactataattaaatgcgatatggtacccaaactggattatgtaagtaaaaaaactggggaaataaaatgtataattcagttaatggtattataccaatgtacttttatttttgataaatgtaccctggttatgtaatatactaagattagagaaagctggatgaagggtatccggaactctgtatttttaaaactcctttgtaagtttaaaattacttaaaaatatattaaaaatgtatatttacctttgtactggtttgagtaaaaaaactgactttagaatgttaacattttagatggtgaaattagaagtaattcaatttttaggtaatgtttcttaatttacttataatgaacatgttttacttgtgtaataataaatttaaaaaacctgatagtaatgtaaatactctttggtaacctgcttttgtccgagaacatcttcccatcttaataaaaatacacctttatttactcttaa

SEQ ID NO: 3786 - DNA, 2563 bp, Homo sapiens
ctcagggaggcggggctcgttccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaa

SEQ ID NO: 3787 - DNA, 2762 bp, Homo sapiens
gatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcagggagcttatggtctagtgagggagacagaggacgatgtcatagaacaagaactctggcgaggtatgcgtggagcctgtggacatgctctatccatgtctaccatgactccctgggaatccatcaagggaagctctgtcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccaca

SEQ ID NO: 3788 - DNA, 1003 bp, Homo sapiens
gcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagt

SEQ ID NO: 3789 - DNA, 1098 bp, Homo sapiens
agttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtcctgcatctccagtatggaatgtatgtttggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaagt

SEQ ID NO: 3790 - DNA, 904 bp, Homo sapiens
gccagccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctgg

SEQ ID NO: 3791 - DNA, 1049 bp, Homo sapiens
ttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcaggtgcgtgcagcagcacccgccaggaggcgcctgaggtcaggagcggatgtcggctgacttggctgggttcctgagggaccgggggtgcggacgctcagctgcgcagcttcctgctttaggttgacccccggagcaaaaacgtcggatatgaagcccttcggtgcattaaatgtctctcaattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagac

SEQ ID NO: 3792 - DNA, 1006 bp, Homo sapiens
agccgcccgttgccagttctgcgcgtgtgagtctctttcgccttgctccgggctttcttcgctcgcagcgcggcagggttatcaccagatctgggctttccccttcttgccgtcaggtgctacggccacgtggcccgcggcttcccgctcgcgcagtctggcagcccggagccttccgcggtcccccgcccgcccggggcccaacgacgccctactgggcgagcacgatttccgaggacagggggtccgggcccagcgctttcgattctcggaggagccgggtccgggggccgacggggctgtcctggaggtccacgtcccgcagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaaccagaagattttgaagacattttggctacaatatattttttgatgcacaagaatcccaaggtccaattgtggtctacttatcaagttaggagtgctgactggtcacttgaagctttactctacaaatgggatatgaaatgtgtccacattcctcttgagtcttttgatgcagacaaagaagatatagcagaatctacccttccaggaagacatacagttgaaatgctggtcatttcctttgcaaaggacagtctctgaattatacctacaacctgttctgggacagtatcaatactgatgagcaacctggcacacaaactatgagcagaccacttcagcttgagaatgcagtgggtctgaagatggtcaagtctgtttgccttagattttgatgtcacctagacaacacttaaactcatatgaaacaaaaattaaaatacgtattacaag

SEQ ID NO: 3793 - DNA, 3121 bp, Homo sapiens
cttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggagggcggttccgccgcgcggcgggcgcgccgcccacatggcggccatcagggcgctgcaacagtggtgccggcagcagtgcgagggctaccgcgacgtgaatatctgcaacatgaccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggccgctcccccattgggggcatggcaggcgtgaagagggcctcggaggactctgaggaggagccgtcagggaagaaggctccagtccaggcggccaagctgccctcgcccgccccagcccggaagcctccactatctccagcccagacaaaccctgtggtccagaggaggaatgagggtgcagggggcccgccccccaagactgaccaggcattggcgggcagcttggtcagcagcacctgcggggtctgcggcaagcacgtgcacctggtacagcggcacctggccgacgggaggctttaccaccggagctgcttcaggtgtaagcagtgctcctgcacgctgcactcgggggcctacaaggccacaggagagccgggcaccttcgtctgcaccagccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggtgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggcggaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggagaagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatgg

SEQ ID NO: 3794 - DNA, 2315 bp, Homo sapiens
atggcggccatcagggcgctgcaacagtggtgccggcagcagtgcgagggctaccgcgacgtgaatatctgcaacatgaccacccacctccccgcagccgcctctgcaagccccaagttgacgggtctggtcccccgacagccaggggccatgggtgtggattccaggacctcctgttccccacagaaggcccaggaggcaaacaaggccagaccgtcggcctgggagcctgctgcgggcaactcgcctgccagggcttccgttccagctgcacccaaccctgcagccaccagcgccacgtccgtccacgtgaggagcccagccaggccctctgagagccgcctggcccccactcccacggaggggaaagtccgccctcgtgtgaccaatagctccccgatgggctggtcgtcagctgccccgtgcacagcagcggctgcctcccatcccgccgtgcccccgagtgccccagaccctcgcccggccacaccccagggtgggggagccccccgagtggcagctcctcaaaccacactcagttcaagctccacatctgcagccacggtggaccccccagcctggaccccgtccgcctccaggacccagcaggcccggaataagtttttccaaacatcagcagtgccccccggcaccagcctttctggcagaggtcccaccccgtcacttgttctatccaaggacagcagcaaggagcaggcgcggaacttcctcaagcaggccctctcagcgctggaagaggctggcgctccggcgcctggcaggccctccccagccactgccgctgttcccagttctcagcccaaaactgaagcaccacaagcaagtcccttagccaagccgttacagtcctcgtctccccgggtgcttggcctcccttcgaggatggaaccgccagccccgctgagcacgagcagtacctctcaggcatccgcgttgcccccggcaggcaggaggaacttggcggaatcctcaggggtcggcagggtgggtgctggctccaggccgaagccagaggccccgatggcaaagggtaaaagcaccaccttaacgcaggacatgagcaccagcctccaggaaggccaggaggacgggccggcaggatggagagcgaatctgaagcccgtggacaggagaagcccagctgagaggactctgaagcccaaggaaccacgggccctggcagagccgagggcgggggaggcccccaggaaggtctcaggcagctttgctgggagtgtccacatcaccctgacccccgtgaggcctgacaggaccccacgcccagccagcccaggacccagcctcccagccaggtccccctccccaccccgccgcaggagactggccgtccctgccagcctcgacgtttgtgacaactggcttcggccggagccccctggccaggaagcccgagtgcagagctggaaggaggaggagaagaaacctcaccttcagggcaaaccagggagacccttgtccccggccaatgtccctgctctgcctggcgagacggtgacctccccagtcaggctgcaccccgactacctctccccggaggagatacagaggcagctgcaggacatcgagaggcggctggacgccctggagctccgcggcgtggagctggagaagcgactgcgggcggccgagggagatgacgctgaggatagcctcatggtggactggttctggctcattcacgagaagcagcttctgctgagacaggagtcagagctgatgtacaagtccaaggcccagcgtctggaggagcagcagctggacatcgagggcgagctgcgccggctcatggccaagcccgaggctctgaagtcactgcaggagcggcggcgggagcaggagctgctggagcagtacgtgagcaccgtgaacgaccgcagtgacatcgtggactcgctggacgaggaccggctccgggaacaagaggaggatcagatgctgcgggacatgattgagaagctgggcctccagaggaagaagtccaagttccgcttgtccaagatctggtcaccaaaaagcaaaagcagcccctcccagtagtagccagtagggccgtgggctcggcccggacctggcatccggacttggactcggggccatgggcttggcccggacccggaacccggacttgtactcggggccgtgggctcggcccggacccggcattcggacttggactcgggaagggcctcctgtccctacaaggggcatgtggacagcagggacctgcgctaccgtctgtggtctcaataaagaaaccgaccacatggccccgg

SEQ ID NO: 3795 - DNA, 6318 bp, Homo sapiens
ccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtgga

SEQ ID NO: 3796 - DNA, 5827 bp, Homo sapiens
ttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgtggaa

SEQ ID NO: 3797 - DNA, 550 bp, Homo sapiens
atcgctagggaacccacggtgactgaatcaaagggaagaaagacccaagacctggatctcccttttacatggaccctaaagcaaaggtcctgtaggtgaaaaatgttgaagagcctctcactcagactgagtgaatatgagaagaactagatggaaaaggcatcctcactaccgatagcaaggtcagacagtgttaggatttgtgccggaacatgtgtgtgtacatggcatgcacatgcacaaaaaggcgttcaaaaatcatcggtgagtcactcaaggagcacactgccattcactttgtgattagcctggaaaggagcaatttcatgtctcgtttctgctgaaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcct

SEQ ID NO: 3798 - DNA, 667 bp, Homo sapiens
gtaggcgctaccgggcgtccggcgcagagtgcggcgcagcggccgctgtcgggctggccatggcgaggggtgcacggcggccacctgagtggcgcggcggtgtcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagagga

SEQ ID NO: 3799 - DNA, 481 bp, Homo sapiens
aggctcctgtaggtgggaagctccgcgctcccggcagccggcggcgcagctcgcaacgctgtgaggcgccggcggaggcggctcgcccgcagtaggcgctaccgggcgtccggcgcagagtgcggcgcagcggccgctgtcgggctggccatggcgaggggtgcacggcggccacctgagtggcgcggcggtgtcagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaa

SEQ ID NO: 3800 - DNA, 725 bp, Homo sapiens
ccgtaatgtctggtgatgttccccagcctgtgggaggcagatgagattgaaaccagggtgtacatgagtgacctggagcccgtaagtaacagtaacacagagcagagagcgctagatgaggtggagctcagaggagcatgggaagttgaatgagacagtaaggagcattctggaagctataatgggtagttaggagaatgccagagtgattctgatgcagtccttccaaatgccggcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatc

SEQ ID NO: 3801 - DNA, 564 bp, Homo sapiens
gcagagtgcggcgcagcggccgctgtcgggctggccatggcgaggggtgcacggcggccacctgagtggcgcggcggtgtcaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggt

SEQ ID NO: 3802 - DNA, 1574 bp, Homo sapiens
attccccatcacctgtctctctggtgagctgcttccgatcagcctccaggtccacgatttctcttctgttgtccttttctgccttctcacctcatcctctgagacctgaatttcgatggctctacttttcaattatattattctttttcaaacctgggcgttcatttctagcatcctgttctatcctgtgtctgactgtgcctcccgcaccttctcccttctctcgccctaagccccgtgaaggcgccgggcctttggctccggctgtttcccacggcgcccagaaccgcgtcagtcctgacacagactcggtgagggcgggaagtggtgccgtggggctgcagcctggcccgcccgctccatcggcctagggcggccccaccgccctccgggccttaccttgagttcgggctgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 3803 - DNA, 698 bp, Homo sapiens
gggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcgccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 3804 - DNA, 961 bp, Homo sapiens
cagccacctgccactcctgactgcatggaagccaggtgcaaggagaaaggattttgaggaggggactccatggcttccgagttgctgactgaccctccacctcagaggtagttctgacactgtctcagttttgcagatgaagatgagattcttcagttctccatgtggaaaagcagctgtggacccagccgaccgctgtaaggaggtacagcagatccgcgaccagcaccccagcaaaatcccggtgatcatcgagcgctacaagggtgagaagcagctgcccgtcctggacaagaccaagtttttggtcccggaccatgtcaacatgagcgagttggtcaagatcatccggcgccgcctgcagctgaaccccacgcaggccttcttcctgctggtgaaccagcacagcatggtgagtgtgtccacgcccatcgcggacatctacgagcaggagaaagacgaggacggcttcctctatatggtctacgcctcccaggaaaccttcggcttctgagccagcagtaggggggctcggcctgggagtcgggcggccccggtcaggccctgcccagagagctcctggttcctgaactgagctgcctctaccgtggtgggctgggcaggcatgtgcccccctagtcagagggcaccaacccacctactctgcccctgggtggatcctgggccggtcgtgttagggttgtccctctgggtgctggctggtgggatgggggagggtggggagcagctcccagcacccctgctgtgtggttcatcttttttttaggcccctgcctgtctgcccatctgcccctcacccacccgaggctctgcccaccgcctggacctgcccacccctgaaagactggcccctggctccccgcccctcggtctccacgtggtgtatggatctgtggtcattgtccctctgcagaataaagattgctcaggcctgcctggc

SEQ ID NO: 3805 - DNA, 2688 bp, Homo sapiens
acgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccctgcaccatgccgtcggagaagaccttcaagcagcgccgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaa

SEQ ID NO: 3806 - DNA, 2618 bp, Homo sapiens
ggcggggtgcctgccgtaccccggccaccgccgcccccgcaagcgcgctgcgggcgagggtcgcgcttctggggcccaacagcccccggggccgcgctgggccgttcggctctgaagcggggctgcgccgggacccagcgcgtcaccttcagggctggttttcccgtcgagggagcccgcccgggtgcgagtgcctcttacagacctcagtgcctcggtcgagaggaggggaatgtgctgggccccggcctcgccgcgcccgggacggcccacagcggtgttgccagttcctgtctgtagcccaggagctggggtgggagacttctcttgggtttgcgattacgttctcaccttggcaccaggaataccgaatacatcccttttctgccggttcagactggaaacccagcttaggtgtgctggcatttggttaaacgtgcaggtgtcaccatcacaatatttactccacgcagatgatgcgaagtgattatttcccgcttgagcaagagaacgccgcagatccagaacaaagagtagaagatgtccgacttattcgagagcagcatccaaccaaaatcccgggtggaagaattactgtatatagaaaagatgtccgcagcgttcagtaaacacagacactaatgagactcagaggctcatctgtggtcaggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctatgcctcccaggagacgttcgggatgaaattgtcagtgtaaaaccagaaaaaatgcagctcttctagaattgtttaaacccttaccaaggaaaaaaaagggatgttaccaactgagatcgatcagttcatccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcagagagaccctgagtcttctcttcaggttcacaaaacccgccgcctttttgggtagaagttttctactcagctagagagatctccctaagaggatctttaggcctgagttgtgaagcgcaacccccgcaaaacgcatttgccatcacagttggcacaaacgcagggtaaacgggctgtgtgagaaaacggccctgactgtaaactgctgaaggtccctgactcctaagagaaccacacccaaagtcctcactcttgcaggggtagacatttctggtttggtttgttctctagatagttacacacataaagacaccactcaaaaggaaacttgaataatttataattttgatcgagtttcttaaaagaccctggagaaagagtggcatttcttctgtttcaggttttgtctgagttcaaactagtgcctgtgttgttacggaaagcagcagtgtaccagtgtcactctggagtacagcgggagaaacacaaaatagtataactgaaaacattaacattcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaatt

SEQ ID NO: 3807 - DNA, 1182 bp, Homo sapiens
gttaggttcccggttgcgggacagtttttttttcttttttaaaacagacacagctactgagtgcaatgccgcctccacagaaaatcccaagcgtcagacccttcaagcagaggaaaagcttggcaatcagacaagaggaagttgctggaatccgggcaaagttccccaacaaaatcccggtggtagtggagcgctaccccagggagacgttcctgcccccgctggacaaaaccaagttcctggtcccgcaggagctgaccatgacccagttcctcagcatcatccggagccgcatggtcctgagagccacggaagccttttacttgctggtgaacaacaagagcctggtcagcatgagcgcaaccatggcagagatctacagagactacaaggatgaggatggcttcgtgtacatgacctacgcctcccaggagacatttggctgcctggagtcagcagcccccagggatgggagcagccttgaggacagaccctgcaatcctctctagcccatgtcgggaaggatgtgtgctctgacagacgtgtcagatgctggcagaagggattggttttctcctgtgtatacagtggaggagtctgagaagcagggatgcctggggtgatcagctccaaccagtggcagcagagtggtggctcttcctagtttagtttttgtgctccgtgttcttgtgtccttctaagaaaaatgtgggctgctcttgaaagttatataattatcatttttttttttttgaaacagggtcttgctctattgcctaggctggagcacagtggcatgatcttggctcactgcaacctccgcctcctgggttcaagtgattcttctgcctccaccccccgagtggctggtattacaagcacatgccaccacaccaggctaatttttgtatttttagtagagacggggtttcaccatgttggccaggctggtctcgaactcctgacctcaggtgatccacccacctcggcctcccaaagtgctgggattacaggcgtgagccactgcatccagccatataaccgtattctaaataagaaatggttggcttgtgtgatggttttgtgtaatgagctagagataatattttaagtgtcttctgtggtatatgtgggagggccattaaggagtgggtttcactccctgcatgtgggcaggtgtcc

SEQ ID NO: 3808 - DNA, 2211 bp, Homo sapiens
gttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagtagtcatc

SEQ ID NO: 3809 - DNA, 3841 bp, Homo sapiens
gcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaatctgttcaacaaacttgtttaatttgtttaaatcaacatagcatgaaacaccaaataaaatgtttgacatagtt

SEQ ID NO: 3810 - DNA, 2795 bp, Homo sapiens
gtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggc

SEQ ID NO: 3811 - DNA, 2622 bp, Homo sapiens
aaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttg

SEQ ID NO: 3812 - DNA, 3119 bp, Homo sapiens
atatcatattttcccctctctgctgtgggctgaatattttactgtgtggtagcaggaagaagattggaaaaaggtgctgcagcaggaagaagctgggatctgattgaacagcagcggtatgcctggatcagctacagctctccgacatgagagactgaagaagaccaatgcaaggccaattcctcttggtttattcaccattaatgaggaagacgaacagcaaaagaatggaaattccagaagaccaaaagcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttata

SEQ ID NO: 3813 - DNA, 2744 bp, Homo sapiens
gatatttggtctttgcctggctgagggacacaaagcaagaagagggagacatgcagatatgttgcaggatattcaagaaagaaggattttagcatggaagacactaaactgtactcacccgacagctacaaagtgcaagataagaaaaatgcctccagccgccctgcctctgcaatttcaggacaaaataacaaccactcaggaaataaaccagaccctccgcctgtgttacgtgttgatgaccggcagcggctggcccgggagcgacgtgaggaacgggagaaacagctagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacaatggaaaggagccagaagccaaaacagaagcataaccgttggtcgtggggaggctctctccatgggagccctagcatccacagtgcagatccagacaggcggtcagtttccaccatgaatctttcgaaatatgttgatcccgtcattagcaagcggctctcctcttcatctgcaactttactaaattctccagatagagctcgccgcctgcagctcagcccatgggagagcagcgttgttaacagactcctgacgcccacacattcgttcctggccagaagtaaaagcacagctgccttgtctggagaagcagcatcttgcagccccatcatcatgccctacaaagctgcacactctagaaattcgatggatcgaccaaaactctttgtaacaccacctgagggctcttctcgcaggaggatcattcatggcacagcgagctataaaaaagaaagagagagagaaaatgtactcttcctcacatctggcacccgaagggctgtatctccatctaatcccaaagcaagacaaccagctcgctcccgactttggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctgctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagcgggaggaggcagagcgcgcccagaggcagaaagaagaagaagctcgcgttcgtgaagaagcagagagggtccggcaggaacgagagaagcatttccagagagaagagcaagagcgcctggagagaaagaagcgacttgaggagattatgaaaagaaccaggagaacagaagctacagataagaaaaccagtgatcagagaaacggtgatatagccaagggagctctcactggaggaacagaggtgtctgcacttccatgtacaacaaacgctccgggaaatggaaagccagttggcagcccacatgtggttacctcacaccagtcaaaagtgacagtggagagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagag

SEQ ID NO: 3814 - DNA, 9576 bp, Homo sapiens
tgcccgctctccgccgccgcctccgagcagccgcgggccgccctccactccgagcggggggcgcggcggcgacagctgggcagcggctttgggctccgcggggaccgcgccgccgcccccgtgagttattctcacgtcccccggggctcgctgccgcccccgccgacgcctagagtccggcccgggcccaactccctcacgggccccccggcggcagcggcggcggcggcggcggcagcggcggagcccaccgcccgggccccgatgagtaactcccggaataaccgggtgatggtggaaggggttggcgctcgggtagtgcgcggcccggactggaagtgggggaagcaggacggcggcgagggccatgtgggcaccgtccggagcttcgagagccccgaggaggtggtggtagtgtgggacaacggcacagctgccaactaccgctgctccggggcttacgacctccgcatcctggacagcgcgcccaccggcatcaagcatgatggaaccatgtgtgatacctgccgccagcaaccaatcattggcattcgatggaagtgtgcagagtgtacaaattatgatttgtgcacagtgtgttatcatggagataaacatcatttaagacatcgcttttaccgaattactacaccgggaagtgagagggttctgttagagtctcgtaggaaatctaagaagattacagccagaggaatctttgcaggtgccagagtggtgcgaggagtggactggcagtgggaagatcaagatggaggaaatggacgtaggggaaaggtaacagaaatccaggactggagtgcatcaagcccacatagcgcagcatatgtcctctgggataatggtgctaagaacctttacagagttggctttgagggcatgtctgatctgaaatgtgtccaggatgccaagggaggttctttctacagagatcactgccctgtgctaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtggaccttcaatcctgctgttctcactaaagcgaacattgtccgaagtggagatgctgctcagggtgcagaaggaggcacctcgcagtttcaagtgggtgatcttgtacaagtttgttatgacctggaacgaattaaacttctacaaagaggacatggagaatgggctgaagcgatgcttccaactttaggtaaagttggccgagtacaacagatttattcagacagtgatttaaaggtggaagtttgtggaacatcttggacatacaatccagcagcagtttccaaggtggcatctgcaggatcagccattagcaatgcatctggtgaaagactctcacaactcctgaagaaattatttgaaacccaagaatctggtgacctcaatgaagaattagttaaggctgctgccaatggagatgttgctaaagtggaagatttgcttaaaagaccagatgtggatgtaaatgggcaatgtgctggccacacagctatgcaagctgctagtcagaatggacatgttgacattttgaagttacttttgaagcaaaacgtggatgtcgaagcagaggataaagatggtgatagagcagttcaccatgcagcttttggagatgaaggcgctgttatagaagtactacatcgaggtagtgctgatttgaatgctcgaaacaagcgccgacagacaccacttcatattgctgtcaataaaggtcatcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctgctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaagcagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttg

SEQ ID NO: 3815 - DNA, 939 bp, Homo sapiens
acatgaccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaa

SEQ ID NO: 3816 - DNA, 971 bp, Homo sapiens
ctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatggattcaggttacattcctgccaaggattttgatgcctaccaattacaacagagggagaattctgccaaaagaatagaattggtttgccttctagattcatatggtcatggatccagtcttccacagccagattttgatagacatcattggaaattgactgtaaaatgagcccattttttactgtttttttaaagccagctgctgggacctggcagttacaaagtaactggaagcaattcttcattgaaaatgggatcagcatgcttttaaaaa

SEQ ID NO: 3817 - DNA, 2383 bp, Homo sapiens
ggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagtt

SEQ ID NO: 3818 - DNA, 2425 bp, Homo sapiens
aggcccagcggctaggagagtcacgtgagagtgggcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaataagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggcaattagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagtt

SEQ ID NO: 3819 - DNA, 1224 bp, Homo sapiens
aagactttattattttgcttttctgagctaatcaatgactttaatttggaaaagcaactaaatatttggagaaaaccatgaaaagaatatatacttacagacgggccaaggagatcttcaaggacactcctaaagaaaatttcccaggaacgagaaaaatttgctgatgaaggcagtatattttacacccttggagaatgtgggctcatatccttttcagactacattttcctcacaactgttctttccaataagtaataccatattgaagcaacagaacgttaatattactaagctaagaagatggtgtctctgaaagcaaagctaaatcatttaaggcaaagcatgttgaaacaaaaagctcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctg

SEQ ID NO: 3820 - DNA, 2357 bp, Homo sapiens
gtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcgaagactaatgatggtggctttcctgggagcatctgcagtaactgcaagtactggtcttttgtggaagagggcccatgcagaatctccaccatgtgtagacaacctaaaaagtgacatcggtgataaagggaagaataaagatgaaggggatgtttgtaaccatgagaaaaagactgcagatcttgcccctcacccagaagagaaaaagaagaaacgttctggattcagagacagaaaagtgatggaatatgagaataggattcgagcctactccacgccagacaaaatcttccgatattttgccaccttgaaagtcatcagtgagcctggtgaagcagaagtgtttatgacaccagaagattttgtgcgatccataacacccaatgaaaaacaaccagaacacttgggtctggatcaatatataataaaacgctttgatggaaagaaaatttcccaggaacgagaaaaatttgctgatgaaggcagtatattttacacccttggagaatgtgggctcatatccttttcagactacattttcctcacaactgttctttccactcctcagagaaattttgaaattgccttcaagatgtttgatttgaatggagatggagaagtagatatggaagaatttgaacaggcaattagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatcctgtggataaagaattcagggaaccatccacacacctgccaaccctgggaagcatccagttctcaaatcgtttttgctatggatttatactaacaagaacattccttgacttccctcctgctggtgttttaaagccacaagtagggaagatatctggcaggcagaaagaagtctgtgatgataaacaatgatgaggatgacctaggcaccctacgctagtgtgagaagcctgcgccccaggaaggatctgtgttagtccctgggatggctccaaggcctgctctaggaaggcagcatgctcagtgggaacacagcaagattcagaatttaaagtagttgcttcatggctctgtgcactcccttttcttcctcgcagcctccctaagatgactccagtgtgaccctgtgcttagtgagcaatagtgattgagctcatgttccctgcaagtgccatttcctctccaggatgggcctctaaagctgaggcctggctcagagcctgtttgccctctgtcttaaacaattgtaaatatcacttaaattataaccatttgcaataaacatccccaaagtt

SEQ ID NO: 3821 - DNA, 1212 bp, Homo sapiens
caaatgggacacctagaaagactttattattttgcttttctgagctaatcaatgactttaatttggaaaagcaactaaatatttggagaaaaccatgaaaagaatatatacttacagacgggccaaggagatcttcaaggacactcctaaagctcctcagagaaattttgaaattgccttcaagatgtttgatttgaatggagatggagaagtagatatggaagaatttgaacaggttcagagcatcattcgctcccaaaccagtatgggtatgcgccacagagatcgtccaactactggcaacaccctcaagtctggcttgtgttcagccctcacaacctacttttttggagctgatctgaagggaaagctgacaatcaaaaacttcctcgaatttcagcgtaaactgcagcatgatgttctgaagcttgagtttgaacgccatgaccctgtggatgggagaattactgagaggcagtttggtggcatgctacttgcctacagtggggtgcagtccaagaagctgaccgccatgcagaggcagctcaagaagcacttcaaagaaggaaagggtctgacatttcaggaggtggagaacttctttactttcctaaagaacattaatgatgtggacactgcattgagtttttaccatatggctggagcatctcttgataaagtgaccatgcagcaggtggccaggacagtggctaaagtggagctctcagaccacgtgtgtgatgtggtgtttgcactctttgactgtgatggcaatggcgaactgagcaataaggaatttgtttccatcatgaagcaacggctgatgagaggcctggaaaagcccaaagacatgggtttcactcgcctcatgcaggccatgtggaaatgtgcacaggaaactgcctgggacttcgctttacccaaacagtaaccccacactgcaagaggggacccctccacccccagtaccctggaccccctccgcagagtctcggcagagccctttgtgctgctgcttctggaagtagtcccccttcctcccgggatgacctcaggactctgtcggtttcccctctttacccttccccgtccccgtgttctgctgggctctgattctgcccaatgagtatccccataggttctcaaaaacatgaacaagtctgtaaagctcagacatttgtcagcctcaacagcaccacccattcaagcatc

SEQ ID NO: 3822 - DNA, 1732 bp, Homo sapiens
atcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 3823 - DNA, 1074 bp, Homo sapiens
atggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgattcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttga

SEQ ID NO: 3824 - DNA, 1959 bp, Homo sapiens
gtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagctgtcctgcggggccaccatcccaggaagctcagctgccatggtgcctcattttggggtcattaatgggaaattggcccattcccctagactgattatgagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgg

SEQ ID NO: 3825 - DNA, 2006 bp, Homo sapiens
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 3826 - DNA, 2057 bp, Homo sapiens
cccgccgcaccacgctcccgagctcccccgcggcctggagtggtgcgccccggccccgccccctgacgccggtgagggggcgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccagttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttgga

SEQ ID NO: 3827 - DNA, 602 bp, Homo sapiens
atgcagtgtgtgtcccgcatgttggcccaccccctgcatgtcatctcaatgcgctgcatggtccagtttgtgggacgggaggccaagtacagctgtcctgcggggccaccatcccaggaagctcagctgccatggtgcctcattttggggtcattaatgggaaattggcccattcccctagactgattatgagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcagggccagctcttccgaggctccagcctgcttttccgccgggtgtcatcaggatcatgctttgcc

SEQ ID NO: 3828 - DNA, 1572 bp, Homo sapiens
gcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggc

SEQ ID NO: 3829 - DNA, 1159 bp, Homo sapiens
agctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccagccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgatatgaagacttccctgaagaaagttgtgaaggagacctcctacgagatgatgatgcagtgtgtgtcccgcatgttggcccaccccctgcatgtcatctcaatgcgctgcatggtccagtttgtgggacgggaggccaagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcttcagccaggccctggccatccggagctataccaagttcgtgatggggattgcagtgagcatgctgacctaccccttcctgctagttggcgacctcatggctgtgaacaactgcgggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaaga

SEQ ID NO: 3830 - DNA, 1130 bp, Homo sapiens
ggtcacagtctgcgcctgcgcgggccccggctcgctagccgtcctgcgggacgccggcgctgatgggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaac

SEQ ID NO: 3831 - DNA, 1691 bp, Homo sapiens
gccccggctcgctagccgtcctgcgggacgccggcgctgatgggtgagtgtgggacgagcgtggggaagcaccgggctttcttcgcatgaggttggagggaggggaaacgcgctgaagggcccgctggggcaggctgccgccctgggggcccatccctgtcttctgcgcgctccggctgccctggcccggtccctgcgggccccacccaggcggcgcgggcggaatcagttctgagcctcctcggctccgggctcccccgcctgccgcgggtgtttgtccggctgctgggcgacctttcccgcgaaggcgctgtcccttcattcgggcgcgccctgggctggggaggcacctccctggtgcacaggaaccgcaggggcggggaggagccgggagctgcctgcgcccgggggacagcggggatggcaccgcgcaagggcctctgcgtcccgggagactgggatttcggcctcacctcgggacccctgactgtgaagtgtcagaaacggaagaggacttagtgatcttgtccaaccccctccccgcctttcacaggttggggaaatggacgcctggagaacggaaatccagttatcaaaattgactcaagaagagagaacctaacagaacaataacaatggaagaaattgggaacattatcacaaagctatcatcctgccaaactccaggctcagatgtcacaggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaa

SEQ ID NO: 3832 - DNA, 1538 bp, Homo sapiens
aggttaaaaaaagtccttcatgaaaaagaaagatcttaagcagcatgatggattcagaagctcatgaaaagaggccaccaatactaacatcttcaaaacaagatatatcacctcatattacaaatgttggtgagatgaagcattacttgtgtggctgctgtgcagccttcaacaatgtcgcaatcacatttcccattcagaaggtcctctttcgacaacagctgtatggcatcaaaacccgggatgcaatacttcagttgagaagggatggatttcgaaatttgtatcgtggaatccttcccccattgatgcagaagacaactacgcttgcacttatgtttggtctgtatgaggatttatcctgccttctccacaagcatgtcagtgctccagagtttgcaaccagtggcgtggcggcagtgcttgcagggacaacagaagcaattttcactccactggaaagagttcagacattgcttcaagaccacaagcatcatgacaaatttaccaacacttaccaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatctggtcaatgattttatctgtggaggtctattgggtgccatgttgggattcttgttttttccaattaatgttgtaaaaactcgcatacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaggttatatgaaaaaaccatcagttaagtgccatttatcaactgaatagaccttctaagaagaatgcagtttggcctcttttttttttttttttaaaggaaatcccaatcttattatggaaagccatcaactgggtgtggggagtaggtcagagggttagtgaaagtccaggggatttctcctccaagtcctaccacacaaaggaaagtctcaagcctctattcaccccttctcaatcctcacaaaatagggggttgttcaatattgtcttcaatgataaaaactttgtggttaaaagtttctccttaggactagtgacaaagttaggcttatacttttttttttttttttgaggcagagtcttgctctgttgcccaggctggagtgcagtggcacgatcttggctcactgcaacctccgcctccagggttcaagcaattctcctgccttagcctcctaagtagtcctagctactcgggaggctgaggcaggagaatctctttcttaattggccaaatataagttggtgtcgtaactccaggccacagtgagttatgggcaaagcttttttccttaagcatcaacaaaataggataaaaggttccaatagg

SEQ ID NO: 3833 - DNA, 1319 bp, Homo sapiens
gcagtcctgcggggcgccggcggcgatgggttggggaaatggacgcctggagaacggaaatccagttatcaaaatggactcgggaagagagaacctaacagaacaataacaatggaagaaattgggaacattatcacaaagctatcatcctgccaaactccaggctcagatgatgtcacaggttaaaaaatgcccttcatgagaaagatcttaagcaacatgatagattcagaagctcatgaaaagaggccaccaatacttacatcttcaaaacaagatatatcacctcatattacaaatgttggtgaaatgaagcattacttgtgtggctgctgtgcagccttcaacaacgtcgcaatcacatatcccattcagaaggtcctctttcggcaacagctgtatggcatcaaaacccgggatgcagtacttcagttgagaagggatggatttcgaaatttgtatcgtggaatccttcccccattgatgcagaagacaactacgcttgcacttatgtttggtctgtatgaggatttatcctgccttctccggaagcatgtccgtgctccagagtttgcaacccatggcgtggcggcagtgcttgcagggacagcagaagcaattttcactccactggaaagagttcagacattgcttcaaaaccacaagcatcatgacaaatttaccaacacttatcaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatttggtcaatgattttatcggtggaggtctattgggtgccatgttgggattcttgtgttttccaattaatgttgtaaaaactcgcctacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaatttatatgaaaaaaaaccatcagttaagtgccatttatcaactgaatagaccttctaagaagaatgcagtttggcctctttcttaattggccaaatacaagttcgtgtcataactccaggccacagtgagttacgggcaaagctgttttccttaagcatcaacaaaacagaataaaaggttccaataggaaaatgtaagggtttttttttgtttt

SEQ ID NO: 3834 - DNA, 894 bp, Homo sapiens
atgatagattcagaagctcatgaaaagaggccaccaatacttacatcttcaaaacaagatatatcacctcatattacaaatgttggtgaaatgaagcattacttgtgtggctgctgtgcagccttcaacaacgtcgcaatcacatatcccattcagaaggtcctctttcggcaacagctgtatggcatcaaaacccgggatgcagtacttcagttgagaagggatggatttcgaaatttgtatcgtggaatccttcccccattgatgcagaagacaactacgcttgcacttatgtttggtctgtatgaggatttatcctgccttctccggaagcatgtccgtgctccagagtttgcaacccatggcgtggcggcagtgcttgcagggacagcagaagcaattttcactccactggaaagagttcagacattgcttcaaaaccacaagcatcatgacaaatttaccaacacttatcaggctttcaaggcactgaaatgtcatggaattggagagtattatcgaggcttggtgcccattcttttccggaatggactcagcaatgtcttgtttttcggccttcgaggtcccattaaggagcatctgcctaccgcaacgactcacagtgctcatttggtcaatgattttatcggtggaggtctattgggtgccatgttgggattcttgtgttttccaattaatgttgtaaaaactcgcctacagtctcagattggtggggaatttcagtctttccccaaggttttccaaaaaatctggctggaacgggacagaaaactgataaatcttttcagaggtgcccatctgaattaccatcggtccctcatctcttggggcataatcaatgcaacttatgagttcttgttaaaatttatatga

SEQ ID NO: 3835 - DNA, 6224 bp, Homo sapiens
ggaagcaaagaggattgtgggagctccgttgtgcgtcgcttaagtgagggcggcggatgggcgaaggtccggtgactgcgactgtcgctgctttctgaggccacaggaaaggggccgtcggtcgccgccatgacagcgagcgaggcggagtttcttccatctgcacccagttgtcttcagcatgggggagcagaaccactctcccgggaaggagcttcagcacaggacgcgagcagaggctccaggaaagaaaagctggcattcccaggcctatgcccttggggccgtttccaactttatgtctacttttctgacctttcctatctataaggttgtgttccggcaacagatccatgccatggcagtgtcagaggctgtgagacagctttggcatgaaggtcctcaatacttctaccggggaatctaccctcctcttctctccaagacgttgcaagggactcttctgtttgggacttatgatagcctgctgtgctttctctctcctgttgggccacacaccctgggacaccgctgggctgccgggctcatgtctggcgtggtggaggccgtggcactcagcccctttgaaagggtgcaaaatgtgctccaggatggtcgcaagcaagctcgcttccccagcaccttcagcattctcaaggaattcaattcttatgggctttgggggcggctgtcactgggctactatcgtggtttctggcctgtcctggccaggaacagcctggggagtgctctatatttttctttcaaggaccccatccaggatggcctggcagagcaaggcctgccccactgggttcctgccttggtgtctggtagtgtcaatggaacaatcacctgcctagttctgtatcctctgattgtgctggttgctaatatgcagtcccatattggatggcagaacatgccaagcctgtgggcctctgcccaggatgtatggaacactcggggccgaaagctgctcctgatctaccgtggaggctccctagtcatcctaaggtccagtgtgacatggggcctcactacggcaatccatgacttcctgcagaggaagtcgcactccaggaaagagctgaagactgactagctgcagaaagtgtggcatggcagctttgttattctaaatcttccctggttggttctatatagcttacttctttggctaggttgcctaatacagccatcctttagcatctataaactcattgcatgggagaagttcccaactaccaacctgttgagcaaggacaaagcccaaaagtattccttagtcaaaaagaaacgttcaccccagtctctccacagtttcagtagcctcagagccaggaggcctttaaataacatgtaacccagattaagtgtcattcctttaaggaattccttggcaataaacagaaacttaaaaagatgaccttacttaggcactctgagctctgggacccctctaggtgtcctccagaccaaactgagtggaactccaatttcaaagaactatgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggagtgagaagagcgtggcccatggatggaaagaataaaaactttgaaagaaaagatttaattacatgcaaaatagaaacatttgctatagtctgcttggtgttatctgctaggacatttctgagagcaaggtgataacattgcctagaaaccgtttgagtttccctaagaaacctggaagtgaagtgaccatatctcttcacagaaaattgcatattttgttgatgtggttaaatgtagttactatgacataaagatcagaaatcttagcctgtcattcagagccattcaaaatatggtcatcatataactttcaacatattgtcactccacttacataaaccccaaacactagccataatgaactattgttctctccccagacattccatgaactttcccatggccatactctggcccacactattctttccacctgcagtgctccttcttcacatgccagtctaccaaaatccttccagttccttgaagcccagctcagaggtcaccttctctatggagttcttgattttccccaactgaatgtgacattagtctctgtgatgcccctttcttttttttttttttgagacggagtttcgctcttgttgcccaggctggagtgccaatggtgtgatctcagctcactgcaacctccacctcccggattcaagtgattctcctgcctcagcctcccgagtagctggaattacaggcgcccaccaccatgcctggctaattttgtatttttagtagagatggggtctctccatgttggtcaggctggtctcgaactcccaacctcatcaggtgatccacccacctcggtctcccaaagtgctgggattacaggcgtgagccaccgcgcccagcctctgtgatgcccctttctaacagcacttcatacagggtactgattccattatgtcactaatctcatgtgaccctttgttcttgtattcttcaatacctcctactagactgtaaaactcattgaaagcagggatttttgtatgcattttaaaatcttccattgtgcctaggtgctcaataacgttggtcaaattactgagttgattatcaagctgtgatatggtatatcctcagggtgctgtcccttgtacatgacgataaagttattgactcactgtcagcaagacacgtgcctttgggctgtgtttttgctttcttttaataattgatttagttttgtgctaatgataatgatgctgctactgataataataataacaataataaaaattactttcaactggcacatttgatgagtttatattactgatggcatgtttgctattagcaccagttcaggaactgaaatttcacaaacagaatcacactgtacaactgtaccatttgtttcaactctggaattttgaggatttccaagatgacatgtgttatagtttccccctacagatatcttagtaatgccctcctcttgcatctccttactgaaccaaatttgtcctgtatttgtcttacttggttgtagatttagcagtgagaacttctcactgaatgccacagaaattaaagacatggttgttggaggtatgatgtcagagagcatttgccaccaaggttggcagaaaatggctggtccaggagagctgaagatgagcttccacatctgcagatcgggatgtgttgggacagtactcaacttgtggattcaaggaagtatgaacacagagtctgcataaggaaaggaaaaagatgcattcatctcccaagtacactggtgatttccacttatgtcattctgtccatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactatctgagagttgcatacatcagttttcaatattcctagattcaatgtttgtagatccaaattattttttaagagaccgtgttttatctctgacaatgggacagttattacagaatataataaaatgaaaactcacacaatatatgtgatattgtgaaatatatacttggtctttgatcctgtttcttggcatacaactcctaaaatccttagaatttccaaagtgatatctttttgtatgctaataattgactgatggctggcagcctctggttgcttcaggatgggaactagtcaccaggaagaccaaggcaccattagagggttgggacttaacagcctcattcccgacctccagggaggggagagggatggaaggttaagttgatcaccagtggccaatgatttaatcaatcatgcctacgcaatgaagcttccataaaaaccccaaagcactgggtttggagagcttccagatagctgaacatgtggaggttcctggagggtggtgacccagggagggcacagaagctctgagccccttccgcagtacctcaccctatgcatctcttcatctctatcctttgatatatcctttataataaagtggtaaacgttaagtatttccccaagttctgtgaccctttctggcaaattaaacccaaagaaggggtcatgtgaactcaaacttgaagcccatctgtcagaagttctggaggcttggatttgcgactggtgtctgaagggcctgggaacagtcttgtgaaacctagtcctcagcttgtgggatatgacgctatctccaggtagattgtgtcagaatggaattggagtacacccagctggtgttcgctgcagaactgattgctcacttagtgtgtgggaaaactccacacatctggacatggaaatattctgtgctgattgccgtggtgtaagagcaatgcaaaaagtttgggtattttcccctcggagtatattttaaagctaaattgctaataattgcttaaatttactatatttgcctttataaaaactttatgtatgttgaagcttgaagctatgcaattataatataaacatggatttacaactaaagcatgttataatttaaataattgagtttttcaaatcggttcatatgaaatcctaggcaatattgtaaaattatacagacctgtcaactttttccacttaaaagttgtgagcaaaatttaagggcatagtcgttttcaagtaattttaaatgtcaatgttaatatttagtttagtgatgttaatggagctatgttttctgatattaaaaatgagttttaggagttgagaccaataaaataaggaggtaataaatatctatatctgtttaaacacataaaatatacaatttaacactaaaattacttggtataaaaagtcaaaaaaaagaataaaaagccatcatacaacacaatatatgcgtgatatatatttttctctaaatataaactacatcagcttttataaagctcaagttgaaataataacgttttatgacaaatcattatatggtatattctgacttaattttgcatttacaatttatttttaaacactaaatagcattataattttactgggataactatatatagtgtagtatattaaagttaataaaatgacgttgcatatgagagaaaaagcataataaatcagaaacaatataaaaagctttcagaaaagataaaaatattgtatttctctagtctgttcactctccagtgtctctggttctttcatatcatcttcctttcctcaaatcttttaatactccctccctcatcatttccaactagtgaccctactttctatttcattaagaaaacagatacattcagaagagaactgccagtttaaagaacatttacaaagccatcacccatgtaataaccagccagagcaagaaatagagccctttaataacctactcttctccccccaccactgatgacaccgctccctccatcttaggtgtagcccccatgctgacttttgtaataataatttctttgcttttgtttataagttttcttccttataagcatctctaaacaacagttttgttttacagatgttcaaacattaaatgctttttagacttggaattgtgactatcttgtttcactccacattgcttgtgagactcattgatattgcagatagctgtagttgatccatttttattgttgtacagtttaccattgtataaatataccatgatttattcatgataactttgaggaacattctggttgtttgcaggttttatttttacagttcattagttttattgatgtataataattgtatatgtttatggggtatatgtgatattttgatacatgtgtacaatgtgtaatgattaaatcaaggtaattgggatatccatcagctcaaacatttatcatttctttgcattgggaacattccaaatcttctcttctagctattttgaaatacacaataaattgaatactgtggtca

SEQ ID NO: 3836 - DNA, 2004 bp, Homo sapiens
gtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaag

SEQ ID NO: 3837 - DNA, 1760 bp, Homo sapiens
gcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacacgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 3838 - DNA, 1716 bp, Homo sapiens
cgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtattt

SEQ ID NO: 3839 - DNA, 2186 bp, Homo sapiens
gctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaa

SEQ ID NO: 3840 - DNA, 1085 bp, Homo sapiens
cagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttat

SEQ ID NO: 3841 - DNA, 2005 bp, Homo sapiens
gttactttttaaatggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaacc

SEQ ID NO: 3842 - DNA, 1548 bp, Homo sapiens
ccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaa

SEQ ID NO: 3843 - DNA, 1247 bp, Homo sapiens
gcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaac

SEQ ID NO: 3844 - DNA, 720 bp, Homo sapiens
ccgcgacctgccgcccgagctggctgccaggcctatcgccgccgccgagaccctccggccaacagggacccgcggtggccccggcccccccggtagtgtctccctgacccgagtcccgtccccgggcctcttgccttcaaccctggtctttcctcctccccgggaccttgagtccccgaggagagcgagggagaggagcgtcttctgcagggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagca

SEQ ID NO: 3845 - DNA, 581 bp, Homo sapiens
gtctgcgcatcgcttaccgtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtggtgagcagggcagcatttccttctcccactgctgctgagatggcagaaattagtcgaattcagtacgaaatggaatatactgaaggcattagtcagcgaatgagggtcccagaaaagttaaaagtagcaccgccaaa

SEQ ID NO: 3846 - DNA, 527 bp, Homo sapiens
actcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcag

SEQ ID NO: 3847 - DNA, 566 bp, Homo sapiens
ttcccgacccgcgacctgccgcccgagctggctgccaggcctatcgccgccgccgagaccctccggccaacagggacccgcggtggccccggcccccccgggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaa

SEQ ID NO: 3848 - DNA, 736 bp, Homo sapiens
agcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggtgagtgttgacgtcttcccgacccgcgacctgccgcccgagctggctgccaggcctatcgccgccgccgagaccctccggccaacagggacccgcggtggccccggcccccccgggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaat

SEQ ID NO: 3849 - DNA, 558 bp, Homo sapiens
tttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcaggggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaag

SEQ ID NO: 3850 - DNA, 1375 bp, Homo sapiens
gaataaagagatgctggataagcccgaggtcacaagctttgcagtgtagcatcccccaacttgatcccctgtctctttggctccaaaacctacactcagtcctgggagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggttgtta

SEQ ID NO: 3851 - DNA, 891 bp, Homo sapiens
cgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggt

SEQ ID NO: 3852 - DNA, 2640 bp, Homo sapiens
agaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttc

SEQ ID NO: 3853 - DNA, 2500 bp, Homo sapiens
tgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcgattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttgg

SEQ ID NO: 3854 - DNA, 1560 bp, Homo sapiens
gcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtgaaacctaagaaatgagcaggttggcagctagggtttgtgttggaggctttcggtccagtgtcttgcagtcctacaacaagtgagaggcttgctgcca

SEQ ID NO: 3855 - DNA, 918 bp, Homo sapiens
gacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacct

SEQ ID NO: 3856 - DNA, 2271 bp, Homo sapiens
aaggtcatgcctacggccgcggcgcctctgcttccctcccaccccggtttcggccgtcgcctgcttctcccggtcgttctgggctggccccgcccctcctcccttgtctcccctccttccccgctctcacccgctcccggagccgccgggaccccttcccctgcgcagctgcgggagaggcccgttcccgcgagtgcccccgcggcgcagcctcggacccagggcctgcttgacctcctacctctggcccgccgcccctgtcctctgttcccagcaagttccttctgcccttttaatcccccgaagcctccgtttccacatgttcttgacaagatagacttttctgagtcttttggggactaaatgaaacagtggacctctggggccagcccagcccgtctaggtgttgtgatggccactcctgcgtcggctccgcgtgtactgggggccgagggggaagaagggcccgtgtgggtgactgaggctgtgtcctcggtcttcggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtggagtcctcaggggccaggcccagcactctgtcaagagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccaccctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaaccttt

SEQ ID NO: 3857 - DNA, 3712 bp, Homo sapiens
aggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaagaggaagtccattgcatggcctttgtttcttcacctttggtctctgagcatgaggaggactgtgtgtgaactgccagcagctgtagccacctgctcacagcctctctgagaaccccctgaaaccagttgttgggtatccttcccatttgccccctcaggcgtagttttcagaactgcttccacctcgtaatcagaagttgaagattgctgctgcgtggcctgatggagatgactgatgtcttaaggcgcctttccttctgtggcacctcttcgtgtgttctcacctggggacctggcagggcacatctccgctgtgcctactgcaaggcggtcccactgctgctgtattagcaggggaagaatcctggctgtgtggatggcccactccattgaagtcaagtcctgcagcttcatagagcttgagacagtccaagcttcagctctggagggcggaggaaagctcatggcatacccacctggccggaggagcccgattggggttaattttatcttcacgtagcagctgaagtttgaggacaaaagggccacttctgatgcccctctgagtttgttcctgtggtttcacttgaaccagggatgctagatgcaaaagtcatattttagcaatttcttcagacgatatacagaaccccagcgctcagccgttcttatttctttttccttatcgtagaattaagatagggagagcccgatcccacttgcccctgtatcctgtaaatgttgatttatcatctactgtaagcgaggcactgttgtaagcagcagagataaatggataaatagacacaggcttctgccttcaaggagcttagagtctgatggaaagacagacgtgcaaacacaactctgaaagaagtgttttaatggagaagagaggtgtaggcaaagtacactgagaacaaaggagaaggagcaactatgtctccctaggatggccccacaggcgacggaatgcctgcgctgggacccgaagttgactgggaatcccagacagaaggagggtagcctctgtgtttgctcaggatcatgtaatgcatattatagctgggaaatcgcaagtagttcagcatagccagggtgtgtaggggcaggggaaaggcatggagggggaggctgggcaatagggtacaactcatgtctgactccagttctggaacattgattagaccttagttcttgcaagtgctatagtgagtacattcagggtagcaaataccctccctcagcctccccactcccttttccagaaaggtctgctaggctctgccctgcaaactgtccaggctcctctgccctctgggcttgttttcctctttattgctacttggctgtttttcacttggtcctcttcattctatgattaaggcaacccatataattgaaagaaaaataatgtgcagcctgtttcatcccttccacttgttttcttactatttatttatttatttctgagatggaattttgctcttgttgcccaggctggagtgcaatggtggcgatctcggcctgctgcaacctccgcttcctgggttcaagcgcttctcctgcctcagcctcccgagtagctgggattacaggcatgcgccatcacacctggctaattttgtatttttagtagagacggtgtttctccttggtcatgctggtctccaactcccgacctcaggtgatcctcccgcctcggcctcccaaagtgctgggattacaggcgtgagccaccgcacccagcctcctatttgctttaaaagtaatttcctggccggatgcggtggctcacacctgtaatcccagcactttgggaggccaaggcaggtggatcatgaggtcaagagatcaagaccatcctggccaacattgtaaaaccctgtctctactaaaaatataaaaatcagctgggcatggtggcgcacacctgtagtcccagctactcaggaggttgaggcaggagaatcatttgaacccgggaggcagaggttgcggtgagctgagatcgcgccactgcactccagcccggcgacagagcgagaatctgtctcaaaaaaaaaaaaaaaaaaaaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaa

SEQ ID NO: 3858 - DNA, 2615 bp, Homo sapiens
cgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatact

SEQ ID NO: 3859 - DNA, 2464 bp, Homo sapiens
gtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttc

SEQ ID NO: 3860 - DNA, 2611 bp, Homo sapiens
ggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaa

SEQ ID NO: 3861 - DNA, 603 bp, Homo sapiens
acctctaggagtttagggccgggccatcccaacgggctgcccctcccaaaactcactgtttggacaggtgttgggcgtcgctaggcgccgacgaagaacttctttccagtccatggccgacttccgcgcagcagcttctgcatttgctgtttcctacctgctccacccctaccagctcaggcgtcagcaccgccaggccccgtaaaggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggca

SEQ ID NO: 3862 - DNA, 552 bp, Homo sapiens
gagttcattagttccggcttgagggaagcgccttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccatacct

SEQ ID NO: 3863 - DNA, 1706 bp, Homo sapiens
actgtagtttccgccgcgtttatggccgcgttaagtctgagtgccgctttgagttgttgaatgaagtgaacttcatttgtcagcgttcgctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagc

SEQ ID NO: 3864 - DNA, 578 bp, Homo sapiens
tttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcc

SEQ ID NO: 3865 - DNA, 2232 bp, Homo sapiens
ttcctgagtcgttggcgcagctgactcgccacctcctccctcctcgtccccccaccggaggagttttgcggtctgtagagagctatgcagggtgagggcccctagacttcggctttcgccgctgttggtggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagat

SEQ ID NO: 3866 - DNA, 1406 bp, Homo sapiens
gtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatcca

SEQ ID NO: 3867 - DNA, 1841 bp, Homo sapiens
acaggacaatccggggcggggcctgagatgcagtcctgcgagggcggcctcctgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 3868 - DNA, 1947 bp, Homo sapiens
gtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaa

SEQ ID NO: 3869 - DNA, 1837 bp, Homo sapiens
acaggacaatccggggcggggcctgagatgcagtcctgcgagggcggcctcctgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 3870 - DNA, 884 bp, Homo sapiens
atgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaag

SEQ ID NO: 3871 - DNA, 703 bp, Homo sapiens
tccttagtaacctgggcgatagctgatgagacggaagtcctgagagtttgaccgatttaaggtcacgtgcctaggaagtgctggaaccaagactcggagttttctctaatggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagaggtaagatggccttgctaaaatctctctccgtggtctcttttggaatggaggagactgggtcatatcaggaggaagtgttccttcagcttaggatgaaacaagagaga

SEQ ID NO: 3872 - DNA, 952 bp, Homo sapiens
tccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagaggtaagatggccttgctaaaatctctctccgtggtctcttttggaatggaggagactgggtcatatcaggaggaagtgttccttcagcttaggatgaaacaagagagaagacataataaagagaacttaaggataaggcaaagctcttttcctgttgccagattccttttctgttaaactcagatgctacagaggctaggtaagttgtttgaatacccaaacgggtcccatctaagaaaaacaatactggagatgcagtgattggtgcttggccagcgtgaaaaggctctggtgagctggagagcctgtaccttgtgtgagtggaatgcctctgcccagctcctgctgatcattgccaggcacaatgtaggcctggtaatcagtgttacctgatactacgatttttatttccagaagaagctagtaacacaaatttttatg

SEQ ID NO: 3873 - DNA, 870 bp, Homo sapiens
cacgagtctttccttagtaacctgggcgatagctgcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcacca

SEQ ID NO: 3874 - DNA, 895 bp, Homo sapiens
acaggacaatccggggcggggcctgagatgcagtcctgcgagggcggcctcctgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagaggaattggcctggattaggagtcttagagtacctggaatccggtcccatctctaccaccaactggctgtttga

SEQ ID NO: 3875 - DNA, 1501 bp, Homo sapiens
tggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 3876 - DNA, 858 bp, Homo sapiens
tgcggtcgccgccgtcgcacgagtctttccttagtaacctgggcgatagctgatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagag

SEQ ID NO: 3877 - DNA, 871 bp, Homo sapiens
acaggacaatccggggcggggcctgagatgcagtcctgcgagggcggcctcctgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctga

SEQ ID NO: 3878 - DNA, 1847 bp, Homo sapiens
ggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgagggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactctgcacctacctcacagggttgttgtgaggctcaaataaaacatcactca

SEQ ID NO: 3879 - DNA, 1104 bp, Homo sapiens
gcagatccgctgtacttgcgtccgctacagtatgtcaatcgcttgccccagcacagtgggctccgtggcttaagacttgaaccaagtaaacgaagttctcttactgagaagtctcagtttcaaaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaa

SEQ ID NO: 3880 - DNA, 1005 bp, Homo sapiens
gggactcgccgcagatccgctgtacttgcgtccgctacagtatgtcaatcgcttgccccagcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaa

SEQ ID NO: 3881 - DNA, 1069 bp, Homo sapiens
gctacgtcccgtctctagccctggcgctccgccggtcccgttctgcaggtgggcgtcgccgccgacttaccaacaaccgggtcgggggctcccggaagtgctcttgcggcttactgcctggcacagctgtcattcttctctacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaagctc

SEQ ID NO: 3882 - DNA, 1098 bp, Homo sapiens
gaagccccgcccactacggagagcgaaggggactcgccgcagatccgctgtacttgcgtccgctacagtatgtcaatcgcttgccccagcacagctgtcattcttctctacagaagagcttctcctcatcaactggggatgattacagttcttcctaaaaaagcctacttgatgtgaagacaatgaggatgaagacctttatggtgatccacttccacttaatagatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaaaaattagtcagcgagttattcacttatttgatgagaagggcaatgatttgggaaacatgcaccgagcaaatgtgattagacttatggatgagcgagacctgcgactggttcaaaggaacaccagcacagaacctgcagagtatcagctcatgacaggattgcagatcctccaggagcggcagaggctgagggagatggagaaggcgaaccccaaaactggaccaaccctgagaaaggaactgattttgtcttcaaatattggacaacatgatttggacacaaagactaaacagattcagcagtggattaagaaaaaacacctagtccagattaccataaagaaaggaaaaaatgtagacgtgtcagaaaatgaaatggaggagatatttcatcaaatactccagactatgcctggaatagctacattctcatctaggccacaagctgttcaaggaggaaaagctttaatgtgtgttcttcgtgctttcagcaaaaatgaggagaaggcatataaagaaactcaagagacccaggaaagagacactttgaacaaagaccatggaaatgataaggaatcaaatgttctgcatcagtaattttaataaagaaaagcatgctctgagagaaagctc

SEQ ID NO: 3883 - DNA, 681 bp, Homo sapiens
atgaacgaaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcacagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataa

SEQ ID NO: 3884 - DNA, 1141 bp, Homo sapiens
atgaccccaatacgcaaaactaaccccctaataaaattaattaaccactcattcatcgacctccccaccccatccaacatctccgcatgatgaaacttcggctcactccttggcgcctgcctgatcctccaaatcaccacaggactattcctagccatgcactactcaccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctcccgtgaggccaaatatcattctgaggggccacagtaattacaaacttactatccgccatcccatacattgggacagacctagttcaatgaatctgaggaggctactcagtagacagtcccaccctcacacgattctttacctttcacttcatcttgcccttcattattgcagccctagcaacactccacctcctattcttgcacgaaacgggatcaaacaaccccctaggaatcacctcccattccgataaaatcaccttccacccttactacacaatcaaagacgccctcggcttacttctcttccttctctccttaatgacattaacactattctcaccagacctcctaggcgacccagacaattataccctagccaaccccttaaacacccctccccacatcaagcccgaatgatatttcctattcgcctacacaattctccgatccgtccctaacaaactaggaggcgtccttgccctattactatccatcctcatcctagcaataatccccatcctccatatatccaaacaacaaagcataatatttcgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 3885 - DNA, 1542 bp, Homo sapiens
atgttcgccgaccgttgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaacaattatcaatataaaaccccctgccataacccaataccaaacgcccctcttcgtctgatccgtcctaatcacagcagtcctacttctcctatctctcccagtcctagctgctggcatcactatactactaacagaccgcaacctcaacaccaccttcttcgaccccgccggaggaggagaccccattctataccaacacctattctgatttttcggtcaccctgaagtttatattcttatcctaccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctaga

SEQ ID NO: 3886 - DNA, 684 bp, Homo sapiens
atggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatag

SEQ ID NO: 3887 - DNA, 784 bp, Homo sapiens
atgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 3888 - DNA, 956 bp, Homo sapiens
atacccatggccaacctcctactcctcattgtacccattctaatcgcaatggcattcctaatgcttaccgaacgaaaaattctaggctatatacaactacgcaaaggccccaacgttgtaggcccctacgggctactacaacccttcgctgacgccataaaactcttcaccaaagagcccctaaaacccgccacatctaccatcaccctctacatcaccgccccgaccttagctctcaccatcgctcttctactatgaacccccctccccatacccaaccccctggtcaacctcaacctaggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaaccta

SEQ ID NO: 3889 - DNA, 1042 bp, Homo sapiens
attaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaatactaccaatcaatactcatcattaataatcataatagctatagcaataaaactaggaatagccccctttcacttctgagtcccagaggttacccaaggcacccctctgacatccggcctgcttcttctcacatgacaaaaactagcccccatctcaatcatataccaaatctctccctcactaaacgtaagccttctcctcactctctcaatcttatccatcatagcaggcagttgaggtggattaaaccaaacccagctacgcaaaatcttagcatactcctcaattacccacataggatgaataatagcagttctaccgtacaaccctaacataaccattcttaatttaactatttatattatcctaactactaccgcattcctactactcaacttaaactccagcaccacgaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttgaacatacaaaacccaccccattcctccccacactcatcgcccttaccacgctactcctacctatctccccttttatactaataatcttat

SEQ ID NO: 3890 - DNA, 346 bp, Homo sapiens
ataaacttcgccttaattttaataatcaacaccctcctagccttactactaataattattacattttgactaccacaactcaacggctacatagaaaaatccaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttatgtcatccctcttattaatcatcatcctagccctaagtctggcctatgagtgactacaaaaaggattagactgaaccgaat

SEQ ID NO: 3891 - DNA, 1378 bp, Homo sapiens
atgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacgggcttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaaccctcattcacacgagaaaacaccctcatgttcatacacctatcccccattctcctcctatccctcaaccccgacatcattaccgggttttcctctt

SEQ ID NO: 3892 - DNA, 297 bp, Homo sapiens
atgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaa

SEQ ID NO: 3893 - DNA, 1812 bp, Homo sapiens
ataaccatgcacactactataaccaccctaaccctgacttccctaattccccccatccttaccaccctcgttaaccctaacaaaaaaaactcatacccccattatgtaaaatccattgtcgcatccacctttattatcagtctcttccccacaacaatattcatgtgcctagaccaagaagttattatctcgaactgacactgagccacaacccaaacaacccagctctccctaagcttcaaactagactacttctccataatattcatccctgtagcattgttcgttacatggtccatcatagaattctcactgtgatatataaactcagacccaaacattaatcagttcttcaaatatctactcatcttcctaattaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaattaggtctccacccctgactcccctcagccatagaaggccccaccccagtctcagccctactccactcaagcactatagttgtagcaggaatcttcttactcatccgcttccaccccctagcagaaaatagcccactaatccaaactctaacactatgcttaggcgctatcaccactctgttcgcagcagtctgcgcccttacacaaaatgacatcaaaaaaatcgtagccttctccacttcaagtcaactaggactcataatagttacaatcggcatcaaccaaccacacctagcattcctgcacatctgtacccacgccttcttcaaagccatactatttatgtgctccgggtccatcatccacaaccttaacaatgaacaagatattcgaaaaataggaggactactcaaaaccatacctctcacttcaacctccctcaccattggcagcctagcattagcaggaatacctttcctcacaggtttctactccaaagaccacatcatcgaaaccgcaaacatatcatacacaaacgcctgagccctatctattactctcatcgctacctccctgacaagcgcctatagcactcgaataattcttctcaccctaacaggtcaacctcgcttccccacccttactaacattaacgaaaataaccccaccctactaaaccccattaaacgcctggcagccggaagcctattcgcaggatttctcattactaacaacatttcccccgcatcccccttccaaacaacaatccccctctacctaaaactcacagccctcgctgtcactttcctaggacttctaacagccctagacctcaactacctaaccaacaaacttaaaataaaatccccactatgcacattttatttctccaacatactcggattctaccctagcatcacacaccgcacaatcccctatctaggccttcttacgagccaaaacctgcccctactcctcctagacctaacctgactagaaaagctattacctaaaacaatttcacagcaccaaatctccacctccatcatcacctcaacccaaaaaggcataattaaactttacttcctctctttcttcttcccactcatcctaaccctactcctaatcacataa

SEQ ID NO: 3894 - DNA, 525 bp, Homo sapiens
atgatgtatgctttgtttctgttgagtgtgggtttagtaatggggtttgtggggttttcttctaagccttctcctatttatgggggtttagtattgattgttagcggtgtggtcgggtgtgttattattctgaattttgggggaggttatatgggtttaatagtttttttaatttatttagggggaatgatggttgtctttggatatactacagcgatggctattgaggagtatcctgaggcatgggggtcaggggttgaggtcttggtgagtgttttagtggggttagcgatggaggtaggattggtgctgtgggtgaaagagtatgatggggtggtggttgtggtaaactttaatagtgtaggaagctgaataatttatgaaggagaggggtcagggttgattcgggaggatcctattggtgcgggggctttgtatgattatgggcgttgattagtagtagttactggttgaacattgtttgttggtgtatatattgtaattgagattgctcgggggaatagg

SEQ ID NO: 3895 - DNA, 2754 bp, Homo sapiens
ttgatgaatgtcactggtgtgtcatcagtttgcatgtctatcatccactttagttggtgcttttctaactttatctccctctagtagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcctttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccacc

SEQ ID NO: 3896 - DNA, 3178 bp, Homo sapiens
agtgaccgccctttgccactccccctgcctcctctccgcctttaacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgtt

SEQ ID NO: 3897 - DNA, 543 bp, Homo sapiens
tgcgcggggcgggggtgggctctggccctgactcctgcgcccggtgtgggaaggtgggaggccttttctaagtagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctgg

SEQ ID NO: 3898 - DNA, 5224 bp, Homo sapiens
agtgaccgccctttgccactccccctgcctcctctccgcctttaacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcctttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgata

SEQ ID NO: 3899 - DNA, 1467 bp, Homo sapiens
agtgaccgccctttgccactccccctgcctcctctccgcctttaacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtaaaaaaaaaaag

SEQ ID NO: 3900 - DNA, 5651 bp, Homo sapiens
gcagcctcggcagcggcggcggcggagccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcagtgcgcgatgatttctttggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggagctggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgcttccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgta

SEQ ID NO: 3901 - DNA, 5605 bp, Homo sapiens
ccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccactgctacgacgaggaggtggtcaaggagctcatgccgctggtggtgaacgtgctggagaacctagactcggtgctcagcgagaaccaggagcacgaggtggagctggagctgctgcgcgaggacaacgagcagctgctcacccagtacgagcgtgagaaggcgctgcgcaggcaggcggaggagaaattcattgagtttgaagatgctctggaacaagagaagaaagagctgcaaatccaggtggagcactacgagttccagacgcgccagctggagctgaaggccaagaactatgccgatcagatttcccggttggaggagcgggagtcggagatgaagaaggagtacaatgccctgcaccagcggcacacagagatgatacagacctacgtggagcacattgagaggtccaagatgcagcaggtcggaggaaacagccagaccgagagcagcctgccggggcggaggaaggagcgccccacctccctgaacgtgttccccctggctgacggcacggtacgtgcacagatcgggggcaagctcgtgcctgcgggggaccactggcacctgagtgacctcggccagctgcagtccagctccagctaccagtgtccacaggatgaaatgtccgagtcaggccagtcctcggcggccgccacacccagcaccacaggcaccaagtccaacacgcccacatcctccgtgccctcggccgccgtcacacccctcaacgagagcctgcagcccctgggggactatggcgtgggctccaagaacagcaagcgtgcccgggagaagcgcgacagccgcaacatggaagtacaggtcacccaggagatgcgcaacgtcagtataggcatgggcagcagtgacgagtggtctgatgttcaagacattattgactccacgccagagctggacatgtgtccagagacccgcctggaccgcacaggaagcagcccaacccagggcatcgtgaacaaagctttcggcatcaacaccgactccctgtaccatgagctgtcgacggcagggtctgaggtcatcggggatgtggacgaaggggccgacctcctaggggagttctcaggaatgggcaaagaagtggggaatctgctactggaaaactcacagcttctggaaaccaaaaacgccttgaatgtggtgaagaatgacctgattgccaaggtcgaccagctgtccggggagcaggaggtgctgaggggcgagttggaggctgctaagcaggccaaagtcaagctggaaaaccgtatcaaggagctggaagaggaactgaaaagagtgaagtccgaggccatcatcgcccgccgtgaacccaaagaagaggcggaggatgtaagcagctatctctgtacagaatcggacaaaatccccatggcccagcgccgccgcttcacgcgggtggagatggcccgtgtgctcatggagcggaaccagtacaaggagcggctgatggagctgcaggaggctgtgcggtggactgagatgatcagagcgtcccgagagcacccatccgtccaggagaagaagaagtcgaccatctggcagttcttcagccgcctcttcagctcttcctccagcccccctccggccaagcgcccctatccctcggtgaacatccactacaagtcacccaccactgccggcttcagccagcgccgcaaccatgccatgtgcccgatctcggcaggcagccggcccctggaattcttccctgacgacgactgcacgtcctccgcccgtcgagagcagaagcgcgagcagtaccgccaggtgcgtgagcacgtgcgtaacgacgacggccgtctgcaggcctgcggctggagcctgcccgccaagtacaagcagctgagtcccaacgggggccaggaggacacgcggatgaagaacgtgccggtgccggtgtactgccgccctctggtggagaaggaccccaccatgaagctgtggtgtgccgcgggcgtcaacctgagcgggtggaggcccaatgaggacgacgctgggaatggagtcaagccagcgccaggccgcgatcccctgacctgcgaccgcgaaggagacggcgagcccaagagcgcccacacgtctcccgagaagaagaaggccaaggagctccctgaaatggacgccacctccagccgggtgtggatcctgaccagcaccctgaccaccagcaaggtggtgatcatcgacgccaaccagccgggcacggtggtggaccagttcaccgtctgcaacgcgcacgtgctgtgcatctccagcatccccgcggccagcgacagcgactaccctcccggggagatgttcctggacagcgacgtgaacccagaggacccgggcgcagatggcgtgctggccggtatcaccctggtgggctgtgccacccgctgcaacgtgccgcggagcaactgctcctcccgaggggacaccccagtgctagacaaggggcagggggaggtggccaccatcgccaacgggaaggtcaacccgtcccagtccacagaggaggccacagaggccacggaggtgccagaccctgggcccagcgagccagagacagccacattgcggcccgggcctctcacagagcacgtcttcactgacccagccccgaccccgtcctctggcccccagcctggcagcgagaacgggccagagcctgacagcagcagcacacggccagagccagagcccagcggggaccccacgggagcaggcagcagtgctgcacccaccatgtggctgggagcccagaacggctggctctatgtgcactcggctgtggccaactggaagaagtgcctgcactccatcaagctgaaggattctgtgctgagcctggtgcatgtcaaaggccgtgtgctggtggctctggcggacgggaccctggccatcttccaccgtggtgaagatggccagtgggatctgagcaactatcacctaatggacctgggccacccgcaccactccatccgctgcatggctgttgtgtacgaccgcgtgtggtgtggctacaagaacaaggtgcacgtcatccagcccaagaccatgcagatagagaagtcatttgacgcccacccgcggcgggagagccaggtgcggcagctggcgtggatcggcgatggcgtatgggtgtccatccgcctggactccaccctgaggctctaccatgcacacacgcaccagcatctacaggacgtggacattgagccctacgtcagcaagatgctaggcactggcaagctgggtttctccttcgtacgcatcacggccctgcttgtcgcgggcagccggctctgggtgggcaccggcaacggagtggtcatctccatccccctgacagagactgtggtcctgcaccgaggccagctcctggggctccgagccaataagacatcccccacctctggggagggcgcccgtcccgggggcatcatccacgtgtatggcgatgacagcagtgacagggcggccagcagcttcatcccctactgctccatggcccaggcccagctatgcttccatgggcaccgcgatgccgtgaagttctttgtctcggtgccagggaacgtgctggccaccctgaatgggagtgtgctggacagcccagccgagggccctgggccagctgcccctgcctcggaggtcgagggccagaagctgcggaacgtgctggtgctgagcggcggggagggctacatcgacttccgcattggagacggagaggacgacgagacggaggagggcgcaggggacatgagccaggtgaagcccgtgctgtccaaggcagagcgcagtcacatcatcgtgtggcaggtgtcctacacccccgagtgaagctgctgccctgcctggcccgacctgtacataggacccccgaccacctgacccccgcccggcccgcggggtagccagccaggcgccgccgcccctcttctaacctctcaacctgcagctttcacctgagtctggcccctccagcgggcagggagtgcggggatgcggatcagctgggaggaggaggggaggggaacttccacccgaggggaagatgctctcgggacagtttcccgggcagctcctggccagcttccagcccagagtcctcaagtccagggcaccttgggcccagcgcaggcagaatccgaggtggtcctggctctaccctgggcctcctactccccagcacccctggaggaggcaggggctccccgccgccgaggctgcctgccctgggcccacctctgcatgctgctcatggggccaccctgcctcctgggccctcactctgcctaggggagctgggccaggcactagcctttgcccagggaggtgggcctcaggctgcccaggtgcctgcaccccagccggccttctctggggcctccccgtcgtcaagcctctatcctgtctgtccccaccccagctgtcccctgcccagggagctggcataaaagcacgaggcccggctccctggggcagctgcttgagaacagagactgctaccccatcctgcccatgcaggcaggctcttgccagccccgttctgacccgtgtccccccaggctctgcctgggcagaagactcaccttggaggagtgggccctggagtcctgtccctcccagaagcccccagggtgggatttctcaggctgccagggcaggcccaggcctcaggaagaaggggaggcccctggcctctccgggatcagtcctaggacacaggctcagcctcaggttgatgggggatgatgtgctcccggggcctgcctcctgcacggggctccacggagcccagctcccagacacgctactaagtgcctagggttgcccgctgtggcctgcttccagggagcaacagagaggccaccaagcagaggcccgtggggctgaggatggagccgcccccagccgactccaagcccgcagagggcagacgccaccctggactgctctccctgcccagctgggcctctctggcctattcctaccttccaggcccactgcactcctgtctgggaggcccttatgagggcagcccagcccccgcacccacccccaaccagagaagcacagatcttggggagctgccccacaagccccgctggccaccgagggctgcagccgctgcgctgccggcttctccccaccaccctgccacctccactgtgatgtatgtccgctccctcgtctgttcccccaggatctcgaagtgactccgggctgagcagtggggcggctgggggaggggtgacgattctcctcaggctttggccctgcaagcaaacccacatatctgctctgtatgtaataaatgtcttaacgtcgt

SEQ ID NO: 3902 - DNA, 3395 bp, Homo sapiens
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3903 - DNA, 3256 bp, Homo sapiens
gtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3904 - DNA, 693 bp, Homo sapiens
gctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatgctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtat

SEQ ID NO: 3905 - DNA, 1222 bp, Homo sapiens
gtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaaaaatgctgctcatggattctcccttattcaggtggacaacacaaaggttaccatgaaggaaatcttactgaaggcagtgaagcgaagaaaaggatcccagaaagtttcaggttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttctt

SEQ ID NO: 3906 - DNA, 3131 bp, Homo sapiens
gtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3907 - DNA, 3045 bp, Homo sapiens
ccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3908 - DNA, 3536 bp, Homo sapiens
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagcattgttccagtctatgtcggataattatgaacaaatgttttctacaatcattggcattaaatagctctcttcaaagaaagtcacttaaaactttgcagaaaagcatgaagccaccgagaaatgttgcaaactcagaaaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3909 - DNA, 3252 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacacac

SEQ ID NO: 3910 - DNA, 2977 bp, Homo sapiens
tccggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatcatggttggtatgatggaccattctttggggcggaggattgattatgttactctctttaaaatctgttcccatattgaacaggcagattggaaaagctatggttcgatttctcagaagaaatgtttaggtcttagtcaatagttttaactatgccatttgtttaaatgagtgcatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggccacaccagatgcctctgcagtcctcgacagcctcttcagtgtccctcctgcggtgatgtccttactgtccccagccagggccggggaccggtgtttcactgaggacctgcattagaaacattttttaaattgttgtacaggaagagatgtgtctaaaacagcatcttaaagctgagtgtatttctttgcacaaggggtcatgctgatgaattcttctttcattctgatctttgttcagccaacaggagcgtccttttctaatgtcttccattcctaccccccacccaaaaacaaaagaaatatttgtagcttgctatctgtatttgaatttttagcaattttatatttagatactttgaaaaatgtaaatgactaatttggtcattaaatcttgtgacatattcgatattaaaatgatattaaaataaaagtcatataaatacaca

SEQ ID NO: 3911 - DNA, 769 bp, Homo sapiens
tgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcagggttcttgctctattgaccaggctggagtgcagtggcacgatcacggctcactgcagcctcaacttcctggactcaagcgatcctcccacctcttcctccccagcagctgggactacaggcatgcactaccacggcctcccaaattgttgggattgtaagcatgaaccactgcatctggccaggcctggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactcc

SEQ ID NO: 3912 - DNA, 701 bp, Homo sapiens
caagtcattcaaagtcagcatgatccacagactgcgattcacaaccgacgtacagctaggtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtgacactggcctccagcctcaatctgttccgtagctcagagcctgcctgccagggccaagtgccctagagtccacccggtgtcctgaagtcctcggggggaggccagcccctggctcactggcacagggcaggtgggctctcggggaaggtgtcgggggccccctaggagggagcgctggggacattgccatgggacggaagtctgcttggcagtggctttgataagcgatgcttgggggtcagaccaccccctagaggagccacgtgccgcccagccaccttcaatgcctgccaccctgcccgaggatgtacagagccgtgcccacacatttccttgcaacttgatcaaatttcttaaagcaaacaacaaaaatgtacatttctgtttttccttttaataaacaggtgtactctttatca

SEQ ID NO: 3913 - DNA, 1586 bp, Homo sapiens
ggaacgccggggtgtggttccgggtcgtgtgcggctcggggtaatagggctgctgctcggccggccggcggcggcgagcagcaggggcatgagggctaacccgggaagcggcagctgagcgggccgggaggagcgccggtccccgtggatcccgagagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggatggccttcttggacaatccaactatcattctagctcatattcgacagtcacatgtgaccagtgatgacacgggaatgtgtgagatggttctcattgatcatgatgttgacctagagaagattcatcctccttcaatgcctggagacagtgggtcagaaattcagggaagcaatggtgagactcagggctatgtatatgcccagtcagtcgatattacctcaagttgggactttggtattagaagacgctcaaacacagctcaaagattagaacgactccgaaaagagagacaaaaccagatcaaatgcaaaaatattcagtggaaagaaagaaattctaagcaatcagcccaggagttaaagtcactgtttgaaaaaaaatctctcaaagagaagcctccaatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccaatgaccgtggtgacaatggccagcgccagggtgcaggacctgatcgggctcatctgctggcagtatacaagcgaaggacgggagccgaagctcaatgacaatgtcagtgcctactgcctgcatattgctgaggatgatggggaggtggacaccgatttccccccgctggattccaatgagcccattcataagtttggcttcagtactttggccctggttgaaaagtactcatctcctggtctgacatccaaagagtcactctttgttcgaataaatgctgctcatggattctcccttattcaggtggacaacacaaaggttaccatgaaggaaatcttactgaaggcagtgaagcgaagaaaaggatcccagaaagtttcaggtgcttgtgactaaattcactaatttcactggctgtcaaggctgtgttaaggaaaatgggtttgaactgctgtgggttttgagtactggactggatgtcagaaacctttgccatcacgggaaattctgtcactctggatttactgtctgttccccacagctaaattcctctgcagtgtgatttagcaccctggatccccatcaaccagttttggcatttatttgaatgcattaccccactggtttccataaactattttacaattgtttaaaataaatgactgtttatttccacaaaa

SEQ ID NO: 3914 - DNA, 1048 bp, Homo sapiens
atgaaggtagagtttgcaccgctcaacatccagctggcgcggcggctgcagacggtggccgtgctgcagtgggtcctgaaatacctgctgctcgggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 3915 - DNA, 1404 bp, Homo sapiens
aaaaacctgtgggtgcctcagaccacagcagagctcacagaacctgcgggagccaggctgacccgccagcatggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgagaagacttcctggaggtgtttgttgaacatatctgcagagccttcccagactcctgcaaatccaacccatatcaggctgtaagtcagagcaggcaatgcagaagaggagaccagaccaaggggtcagctggggctaggacagtgagggctgctagaggggctgggcctctctttgcacatggacactgggcccctctctatattgagtggtctgttaacattcattggtggctgattccaaaagatgagagccaaagctgcacggactcgagtccta

SEQ ID NO: 3916 - DNA, 3204 bp, Homo sapiens
actgtgtagttcagagtggccacagacaagaggcaggagcgggagggacagggccagctctggggctcctggaggccaggctgagctacttggactgtgcccaaagttatggggaagtcatgaagggcttgaataaggggaggcacctggctggatttatctctgggaaaatggggcagaggatgaacagaaagagagcaggaaagggtctccctttgctctgagatcccaaaagatggaaactagaacagtttatccaaccagttgtccccattgattgagcacttaatgagtacaaacaactctcctggggagaaggaggacaggcaggggatggagtgaattaggcggcctggtgcagtgggagaaagtgagctttggagttaggcctacctaggctcaacgcgtgctcccagtgacactgggctggccgtagtccctctcagggactttgtctcctctttgaatgccccggaagctgctgtcttcctcctgggcccgaggattggacaggacagtgctgctagtgccaggcctatgggcagagttcagtctgagcaatctcacctgccttcctctcagacccctgtccctgacagctccttcttccctccccagccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgagaagacttcctggaggtgtttgttgaacatatctgcagagccttcccagactcctgcaaatccaacccatatcaggctgtaagtcagagcaggcaatgcagaagaggagaccagaccaaggggtcagctggggctaggacagtgagggctgctagaggggctgggcctctctttgcacatggacactgggcccctctctatattgagtggtctgttaacattcattggtggctgattccaaaagatgagagccaaagctgcacggactcgagtcctaggctgcacacctcacaagcatctcttctactgcattctgttggtcgaagcaagtcacaacccagcagattcaaggagtaaggaataggatccccctctggatgggaggagcagcaatgtcatattacaaaagggtgtggacacatgcagggattcttactgccgtctttgcaaacaatccaccaaaacttaaaaactaaaagcctgaagcacaagcactctccaccccaggcacacacaccctggaattccctgtgtgaccatggtaccaccactgtgtgtcccgaggatcccagctcagctttgcatcgctgccctatctccctctcgctctcccctgttgatccctcatgcacagccacagcgagctgtctaaaacacaaagctgaccgcgccatttcctactcagcatccttccatgaccctccattgctcctaggatagggtttggaccagtctgaatccagaggatcaggatccagcaggaaccagaggataatttgaggagggtttaaaaaggaaccattttttgaggtgtgtgcactgtttccaccctgaggcctggaaggatgaatggaagcagcagttcctgaaccaggaagactcatgtgtgggggccattgctggtcaaggggcacgaacaggtctggtgaccctgcaagggaggagccaggagcaagcattcccacttcaccttcctccattcagtctgctgccaagttccccactgcctgagcccaactagaagctggagggaaggagggcctgtggctgcagtccaggcatgtaggcctcctgggaaagggagaatggcaaagacaggcagagtggatctggaggggtcaacggaagacggaacatgtccacttccaggcccgagcttctcagcctgccgtttgccactctccagcatctggcccagcctgtccatcctcatctctcttcctcccttactccgtgctcccatcactcggaaccatttgcatttctttgtctcagctatattgtctcacctctgagtttttgcccatgatgttggatgccatggaatgccatatcctccccattatctcccccttgtctggataattcctactcatcctacaatactgattttatctgtgcaaagaagtcttccccagtgcctctggttgacaggggtttcctctggcttctccagactttctgttcctccaccacagcccttagcaccctggggaggaggtgttgctgtccaggtaaatgctgcgccaatgcccctgcctctagtgcactccctccagcctacccacaaacaggacctgcatcctgtctcacaaataaaactgaactcttgaaatggtg

SEQ ID NO: 3917 - DNA, 2132 bp, Homo sapiens
cactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcatgcctgtaatcccagcactttgggaggccaaggtgggaggatcgtttgagcccaggagttgaagaccagcctgggcaacacagtgagacttcatttctacaaaaattaaaaaataatgttgttaattagccgggcatggtggcatgtgcctgtaatcccagctatttgggaggctgaggcaggagacttgcttaaacccaggaggcggaggttgcagtgagctgagatcacaccacagtactccagcctgggcaacacagcgagactcaatctcaaaaaaaaaaaaaaaaaaaaaaaaaagactgttaaagctgtagtaggctgggcgtggtggctcatgcccataatcccaacactttgggaagccgaggcaggtggatcaactgaggtcaggagttcaagaccagcctggccaaaatggcaaaaccccctctctactaaaactacaaaaattagccgggcatggtggctcatgcctataatcccagctactccggaggctgaggcaggagaatcgcttgaacccaggaggcagaggttgcagtgagccgagatcacaccactgcactccagtctgggcaacagagcgagattccatctcaaaaaaaaaaaaatgttgttaaagctataatcgttctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaa

SEQ ID NO: 3918 - DNA, 933 bp, Homo sapiens
caagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacc

SEQ ID NO: 3919 - DNA, 1219 bp, Homo sapiens
gccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtgggtgagtgcccacctccggggggacggccaccagcagctgcgtgggcatcagggatccctcgcccacctgtctccctctccctgcagtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacc

SEQ ID NO: 3920 - DNA, 784 bp, Homo sapiens
attgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtaaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtctt

SEQ ID NO: 3921 - DNA, 773 bp, Homo sapiens
ggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaatt

SEQ ID NO: 3922 - DNA, 2364 bp, Homo sapiens
cccagcaggcagtgcagcctagagacgctgacaaaggagcggaggagcagtcgcagctgctttccgaggaagccggtgttgccgagattgccaaaatgctttggagtttttaactgaatctaagaaaagtccaaaatagatttgagactgtaaaaacagaaactgcagcaagggggattcagtgccaatgcatcaacaaaaaagacaaccagagttagtggaaggaaatcttcctgttttcgtgttccccacggagctcatattttatgcagatgatcagtcaacacataagcaagtgttgacactgtacaatccctatgagtttgccttaaagttcaaagttttgtgtactactccaaataagtatgttgtcgttgatgctgcaggtgcagtaaagcctcagtgttgtgtggatattgtgattcgtcatcgagatgttcgatcctgtcactatggtgtaatagacaaattccgtctccaagtttccgagcaaagccaaaggaaggctttgggaagaaaagaggttgttgctactcttctcccatcagcaaaagaacaacaaaaggaagaagaggaaaaaagattaaaggaacatttaactgaaagtttattttttgagcagtcgtttcaaccagaaaacagagctgtatcctcaggacctagtttactaactgtcttcctgggagtggtgtgcattgcagccctgatgctgcctacactgggggatgtggaatcgctggtgcctctctacctccacttaagtgtgaatcaaaaattagtggctgcttatatcttaggtcttatcacaatggccatacttagaacatgagcaaggatttcaattgacttctgaagtaaatctgtcttgaaaatatgaatgtggactgccttttatctctatttcactccattaacatgcaacaaactattgaatgatttcaaataattgcaaatgtataatatatattttaaattataatttaatttgaaggactgcagaacattattttacagacagcaaggatgcttctgagtgacacctaggaaattatttgaagaaattctttttatatctatacctgttgtgtaagaaactttaaaacatttgttattttctcacctttttttctaattcactttgattgctaggggtcatgtatgcttcgaagttacaggactaaaagagcaaactgaccggcctaaaactaaaatgacatttattccctagctacaaacatcagcgttattatgttaattataccttgccctctatcattataaatggttgccatggtgtttctaaaaataagtgttttaccattaatgtgtagagggcaaacaaagcataaagtactaagggatcatgcttatcctagggtctcacagaagagaggacatatttaattaatcttgtgaattacagaacaggttgtggtccagacaccaagaatcataggggtttttttttaaaaaacctaatagaagtagggtgacctctctctttggtctaagagttctaaaggaaggtaggcatctgtttaattagttggttcaccctggctttacctctggttaatgctttgtgttaataggaaggaaaaatcactttatcttttcttccaagcccctccctgcctgacttacccagactgggattaccagataccaggtgatttatgtggagatgatttttcacctttaaactctaagccaagtgtaagaaactcttgatagctatgtctattttatatcagtcactgagacttttttttaagtttttatttattattaagacaactttgccaaaaaagtcccctaagcacaactatttacatttctttatagcctcttctgatctctaacacatatgcagttttaactgttattttcatagtaactgatcttttgtctaaggatttttacctgaaagcacaatgtattgagtctcttgaaaatcatctttcagatctttttacagaatgaacttatgcactgctactgtagtattctcaaggaatatatgtaaacacaaatgtatgcctgaggttggtttttgcagaaaacagtctctgcttctaaaaacttctatgtctagtcttccataggaaatcctcactgtttaaccatgtgaggagcctaagtcattaaacggatcatgtctgtacattgtgtaatgaatgaaaagcacataaatgtaatctactttgaactttgtaaaaatgatgtgtggaggctattcttgtttctccatctcaagtcctgtgtgtgcacgtgtgtgcaagtgcacatgtgtgtgtgtaataacacattgtaaagaacagaaattactttaaaaaataaacagaaatggagacctgagcttca

SEQ ID NO: 3923 - DNA, 4163 bp, Homo sapiens
gggcgggactgccgggtgatgagatactcggtcggcgacggtagaacgggcgacggcgacaaccgcaatcacatccacgacggtgatcatggcagagaatcacgcccagaataaagccaagctcatctctgagacccggaggaggttcgaagctgagtatgtgacagataagtcagataaatatgatgcacgtgatgttgaaaggctacaacaagatgataactgggttgaaagttacttatcttggagacataatattgtagatgaaacactgaagatgctcgatgagagttttcagtggaggaaagaaatttctgtcaatgaccttaatgaatcctccattcccagatggttattggaaattggtgttatttatctccatggttatgacaaagaaggtaacaaattgttctggatcagggtgaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgacatggactttgtacgctttatcatcaactgctttaaggtttattaccctaaatacctctcaaaaatagtgatctttgatatgccttggttaatgaatgctgctttcaaaattgtgaaaacctggcttggtccagaagcagtgagcttgttgaagtttacaagcaaaaatgaagtccaggactatgtcagtgtagaatacctgcctccccacatgggtggaactgatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaagattaacccaaccgaatctacttccaaagcagaagaaaatgaaaaagttgattcaaaagtgaaagctttcaagaaaccattgagtgtatttaaaggccccttactacacatcagcccagcagaagaactgtactttggaagtacagaatccggagagaagaaaaccttaatagtgttgacaaatgtaactaaaaatatagtggcatttaaggtgagaacaacagctccagaaaaatacagagtcaagccaagcaatagcagctgtgacccgggtgcatcagtggatatagttgtgtctccccatgggggtttaacagtctctgcccaagaccgttttctgataatggctgcagaaatggaacagtcatctggcacaggcccagcagaattaactcagttttggaaagaagttcccagaaacaaagtgatggaacataggttaagatgccatactgttgaaagcagtaaaccaaacactcttacgttaaaagacaatgctttcaatatgtcagataaaaccagtgaagatatatgtctacaactcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaa

SEQ ID NO: 3924 - DNA, 1053 bp, Homo sapiens
atcggcgtatagttacggcagaaacaaagacgtcctagccaatgacagaggccgtacggcggaagtatagaaaaggactctctggaacatggcaacattaatctgaccacaagctgactggcaggtgctttaaccacaagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccag

SEQ ID NO: 3925 - DNA, 1016 bp, Homo sapiens
cccggaaggggcgaggccagcggcggggcggggcttatggagatcgtgagctgggcctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatg

SEQ ID NO: 3926 - DNA, 1191 bp, Homo sapiens
ctgcgaggggccgggtttagcggggtgggcgtggccgtcgaggtggggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaa

SEQ ID NO: 3927 - DNA, 856 bp, Homo sapiens
atgtccgaccgcccagagcctgcatgcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacattgtgattcgccatgtggcacccattcccagccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatg

SEQ ID NO: 3928 - DNA, 1115 bp, Homo sapiens
ggctcggcgggtccgaaggaacctggggcagagctggaagaggaaaggtcttgggggccctgggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgcatgcgccgtggggcgccccaggaccaggagctggtgggtccggggccccctgggcgggggtcccggggcgcccctcctcccttgggacccgttgtcccggtcctggtctttcccccggatctagtattcagggcggaccagcggagcggaccccgacagctgctgaccctctataaccccacaggaactgcgcttcgcttccgagtcctgtgcacagcacctgccaaatacacggtgtttgacgcagagggatatgtgaagccccagtcttgcattgacatccactatgatgtccaggaccgcttccgcattgagctgtctgaggaaggagctgagggccgagtggtgggacgcaaggacattacctccattctgagagccccagcgtacccccttgagcttcagggacagccagatccagcgcctcgcccagggcctcctgctgggacaccaccacccacggccagacacttccaggagcacccccgccagcaactggccaccagctccttcctcctcttcttgctgacggggattgtgtctgtggccttcctgctgctcccactcccggacgaactcggcagccagctgcctcaagtcctgcacgtctccctgggacaaaagttggtggccgcctacgtcttgggcctcctcaccatggtgttcctccggacctgagctccgtgctcaacccccagcccaccccaccctccctgggcagggtcttgaggcagccactgtgatgctcataccttaccttgcctcctaccctcttctctttcctgcctactccccactcctccctgacaaaaaacacccagggatttgtactcattttccaagttgaataaaatacatttttaaaatgataatcagaaa

SEQ ID NO: 3929 - DNA, 2153 bp, Homo sapiens
aatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaa

SEQ ID NO: 3930 - DNA, 2309 bp, Homo sapiens
aatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtatgagcattctccaaggaaaggatgacatatttttggacctgaaacagaaattctggaatacctatctgagtggactgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatac

SEQ ID NO: 3931 - DNA, 1358 bp, Homo sapiens
cggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccgcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggccttggctgcctggagggtcagacagtgggtgagagctgccaggagctgcgggagaagttctgggaattctacaaggcagactggtgcgtgtggcctgctgcgcagttcgtgaacttcctcttcgtgcccccccaatttcgagtcacctacatcaacggcctgacgctgggctgggacacgtacctgtcctacttgaagtaccggagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaa

SEQ ID NO: 3932 - DNA, 3228 bp, Homo sapiens
atgcctggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcc

SEQ ID NO: 3933 - DNA, 1740 bp, Homo sapiens
gcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataacgttcttaaaagatagaaaattcacctccattttctttgtacttgaagatggcaccactggaataaatacttaagacactg

SEQ ID NO: 3934 - DNA, 3313 bp, Homo sapiens
gcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatggaagattctagagtgtccagctcttgcactacaaatgtaataataacagaataaatacacttaccctgatgatattgagggtacatgattagcctaatgtgatgtcatatgaggaagtttaggagtccatttttcaggtggtttggtgataggaataaaaatgttactcccgtcgctgatttggaagaaaaccgatgaagtacaagtaaggtttccccactcctgtgtgtggtcatgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgcca

SEQ ID NO: 3935 - DNA, 1574 bp, Homo sapiens
agcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagaaatattctctactcttggaatcagtagctagcattcttcaaaacagtgtctctttcatggagagacagacagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccag

SEQ ID NO: 3936 - DNA, 546 bp, Homo sapiens
gccgagcggcgcagctttgcgggcccgaccggctccgcgtggcaggtgaagtgcaccggtttagaacctctgacgtctctcaagccactttagccagtgtagccccagtatttactgtgacaaaatttgacaaacagggaaacgttacttcttttgaaaggaagaaaactgaattataccaagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttgg

SEQ ID NO: 3937 - DNA, 1622 bp, Homo sapiens
acagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcaggtgaagtgcaccggtttagaacctctgacgtctctcaagccactttagccagtgtagccccagtatttactgtgtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattggatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctg

SEQ ID NO: 3938 - DNA, 1591 bp, Homo sapiens
ggtgcacagagtctgcaggtcgggcggtagcgacaggtcagagctgcggcctgagcagccagcgtccggcatgaaggtctggggtctggctgctgcctgcttcttgctccagcaccatggaatgcctgcgcagtttaccctgcctcctgccccgcgcgatgagacttccccggcggacgctgtgtgccctggccttggacgtgacctctgtgggtcctcccgttgctgcctgcggccgccgagccaacctgattggaaggagccgagcggcgcagctttgcgggcccgaccggctccgcgtggcagacaaaatttgacaaacagggaaacgttacttcttttgaaaggaagaaaactgaattataccaagagttaggtcttcaagccagagatttgagatttcagcatgtaatgagtatcacagtcagaaacaataggattatcatgagaatggagtatttgaaagctgtgataactccagagtgtcttctgatattagattatcgtaatttaaacttagagcaatggctgttccgggaactcccttcacagttgtctggagagggtcaactcgttacataccctttaccttttgagtttagagctatagaagcactcctgcaatattgggtcatgttgttatctagatcaacacccttcaggggaaacttagcattttgcagccactgatccttgagaccttggatgctttggtggaccccaaacattcttctgtagacagaagcaaactgcacattttactacagaatggcaaaagtctatcagagttagaaacagatattaaaattttcaaagagtcaattttggagatcttggatgaggaagagttgctagaagagctctgtgtatcaaaatggagtgacccacaagtctttgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacagccaccgaaacgtgatgatgaggttgaatctacagctgaccatgggaaccttctctctttcgctctttggactaatgggagttgcttttggaatgaatttggaatcttcccttgaagaggaccatagaattttttggctgattacaggaattatgttcatgggaagtggcctcatctggaggcgcctgctttcattccttggacgacagctagaagctccattgcctcctatgatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgta

SEQ ID NO: 3939 - DNA, 1409 bp, Homo sapiens
cggcgtgcggcgcggcgggacgggacgtgcggcccagcgagttggtcggtcccggggtcacccgctacgggaagcaggcctcgccacagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaagacttacaggacttcctccttatggaatagttcccagtctactagctcaagtagtcaggagaataattctgcccaaagcagtctgcttccttccatgaatgaacagtcacagaagacacaaaatatatccagctttgattctgagctgtttctagaagaactggatgaattgcctccattgtctccaatgcagccaatttcagaggaagaggctattcagattattgcagaccctccattgccaccagcttcattcacacttcgagactatgtggatcattctgagactctgcagaagttggttcttctaggcgtggatttgtccaagatagaaaaacatccagaagcagcaaacctccttctgagactggattttgaaaaagacattaagcaaatgcttctgtttcttaaagatgtgggtatagaggataaccaactgggagcattcctgacaaaaaatcatgcaattttctctgaagaccttgaaaatctgaagaccagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaagactagagatctggtagttcgtctcccaaggctgctaactggaagtctggaacccgtgaaagaaaatatgaaggtttatcgtcttgaacttggttttaaacataacgaaattcaacatatgatcaccagaatcccaaagatgttaactgcaaataaaatgaaacttaccgagacgtttgattttgtgcacaatgtgatgagcattccccaccacatcattgtcaagttcccacaggtatttaatacaaggctgtttaaggtcaaagaaagacacttgtttcttacctatttaggaagagcacagtatgatccagcaaaacctaactacatctctttggacaaactagtatctattcctgatgaaatattttgtgaagagattgccaaagcatcagtacaggactttgaaaaattcttaaaaacgctttagatttttatgtatgttaaaatgcagtattgtaaagtgaatatatatatgaataaatg

SEQ ID NO: 3940 - DNA, 1790 bp, Homo sapiens
gattggccatgggcgaagggactgatggcctggttggcgctgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccatattataaaatataaatcatatttattttaataaggttggtaacttttaccttgaaccattatttcaaaaactcatatactattaaatggcatatcagtgtgat

SEQ ID NO: 3941 - DNA, 1763 bp, Homo sapiens
gggactgatggcctggttggcgctgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccatattataaaatataaatcatatttattttaataaggttggtaacttttaccttgaaccattatttcaaaaactcatatactattaaatggcatatcagtgtgat

SEQ ID NO: 3942 - DNA, 715 bp, Homo sapiens
ccgaaatcccggctccaggcctcggggactgcggactgtggggaggctggccggagagagagggaaggacggggcctggcccccgggactccctgtgccttgcttggagctgacgccgacggatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataa

SEQ ID NO: 3943 - DNA, 418 bp, Homo sapiens
gagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttca

SEQ ID NO: 3944 - DNA, 581 bp, Homo sapiens
atggtaaggcatttctatgttttattttactttgtctttatcctaaaatgccattggcaagtttattgcagggaactgacaagatcacattttgagaagaagttggaaagaatcccaagtggatgaactgaatatctggatgaggacaagatctgtggggagagactgtaagacctgtaaagagtgagggaaggctgccaacaggctaaattgagccgtactacacacttttgtggcaaggctgagacacttacaacactcttagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaac

SEQ ID NO: 3945 - DNA, 3235 bp, Homo sapiens
tgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacgggtgagtcgcccccttcctctgctcctgggcgtgttcctcaccagcggcgccgcagcggtcagggcccgcaaaaccccacgcctcgccagacgctcagctcagcctgccgggtttctctggaaaagcggaggccccacagtgaatgtgcggccttttgatcggtcctggagatcttccgtggaccctcgtttttccttgcttataaacgttggtcaatttgaaactggcagcagggcatatgtgttacgaaagaagaactttattgaaaccagtggtggtgtagagaagaccatactaaccataactgtgtattacagaagtgaatttcactccccaaaaatgcttaagaaacaagcatcctagaacagcccacattgtgatttaacaaacatttaccaaaagcattgctatatgtgggggcacagggctaagagcaggcaggactctggagccaacctgtggggtttgagtccaaattctgccggttttttgttttttgtttttttttttagctgagtaaccttgggcaagttcctttacctgcgtctgtttcctcattttaaaatgagttgttgtgatgatttaatgatttagtatatgtgaagagttttctgcatattctaagtgatttatggtattaactcgtttgatctttgcagtcacccaggagatagtatcaccattttcctgatgccaaactgaggctcagagaggtgaagtaacttcttcaagtcacaacacaactgttgtccaggaatcaggcagtctggctctgctaacccagttttacccactgcattaatgtaccgcatccacttgttcactcagtttcacctgacaaatactaattttgtctctctgtggaacaagttctttgctgggtgcagggaataaagcagaacaccgttcagttcctgccttcccaacgcttgtaaatctagtgcaggtcattcatggccgggctgcagggtgtccatgaatcctgctaaaatcatttgcgaaatgttgtgagcgtgggtcttttcttctggaaagagagtctgtgactctcaggttctgagttgatctgtgatccaaacagaggtgtgaagaagtgttgttttagcagatctgtgcctagtatgcctgatacacagcttgaacttcaaacaaacagcaacaaaattcctactggttggaagaatgaagaacttgtaagagcataataagtgctgcagtagcgtccggagcagggtgctgtggaagagcacacagaaggccacctgcccaggaatgcctcctagaggcagtgaaggcagctgggtgaaggatagggaagcagttcattggaacactgtggtgaccagtctgtccatgtagtgttgagacagaaacaacacgtgaacagctgcagctgttgtaccacttgtgcgcaagtgtaaaagtccatggtgccatgaaatcatgtaatggggacaggaggcttcatgtattcgtgaaggttagaaaagtttccttgagaaagtgacacttaggcctaaaagttggagcattttgggcatggaatctggcccacagtcttcaaagaccacatggtagaaaccagtagagcaccagggactgacaggaagcaaatgcagctggtgcaggagagggaaatgggaattagggtggtggcagagcccaaagaggccttgtaggccatggtaaggcatttctatgttttattttactttgtctttatcctaaaatgccattggcaagtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactga

SEQ ID NO: 3946 - DNA, 3651 bp, Homo sapiens
agagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacgacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtgagaaa

SEQ ID NO: 3947 - DNA, 3206 bp, Homo sapiens
ctttcacaacagagaaagaggcaactacattgcctggaggaagcctaaggaacccaggcatccagctgcccacgcctgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagtgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 3948 - DNA, 1534 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatg

SEQ ID NO: 3949 - DNA, 1273 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatg

SEQ ID NO: 3950 - DNA, 603 bp, Homo sapiens
atggatttcggactggccctcctgctggcggggcttctggggctcctcctcgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctga

SEQ ID NO: 3951 - DNA, 1509 bp, Homo sapiens
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcccttcacgctctgtccaatcccgaagcccctgcggcagaaagcccccaagcaccttctctctccacgccagcctcctcccacccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 3952 - DNA, 1485 bp, Homo sapiens
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgctccatggctggctctctcctcctccccctcagaacacgggccctcacgggcctcacccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 3953 - DNA, 1461 bp, Homo sapiens
ctatttaagcggcttccccgcggcctcgggacagaggggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcccttcacgctctgtccaatcccgaagcccctgccccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaacc

SEQ ID NO: 3954 - DNA, 1957 bp, Homo sapiens
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcgcaccgcaaagaggaaccacccctgtctatgaaatgtacccttttctctggtgacattggcccatccttatgagcataataaaatcgcagaatcaaagcgctgcaagagatcttaaaaccacctaagtctaccactgagagcccaagaatcttggaaggacttcacagctggcctcatgccttcactttatatctcagggcattttctctcatttgtaaagggacttgtccttgatcaaattggtaatgtcagccatgggaggagaaatcaagtctcccgactgcaaatctttgtatatttggtatcatgccattcatttctgtcctgtgcaaagatcactataaaaactaatacgaggtatgagtggtctaagagtgtgaatatcagtcatgatcattggtgaatctgatttctgaatgttatgtggttctgcttctgttttctactgccaatatatgctgaatgttctctcttagccaacaggcatagcctcatataaaaaatgggggaaaaaaaacatttattagcccaagaagccaatgggttcaaggtcactcccaacatttttatgccatcaagtatatcagctccaaaagaggcttttcctttgccattggggggtattttgtttgctgtcgtttattttagttctccactgcttcggtgtagaggacctatgctgcctgtaggcttgacctttcctatactttttctgctgtctgaagttgctaaaacatttggccttaataaaaacactaataaaggttttattaatctgt

SEQ ID NO: 3955 - DNA, 2337 bp, Homo sapiens
atgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctag

SEQ ID NO: 3956 - DNA, 1211 bp, Homo sapiens
ctgcatgtttgatttagcaggtgaagtttttagtatttaatgtgagtattttagaaccccagatatgatgtttgttatgtaatctgtactaacagttttgcaatgggaaactcttcccttactggtttgagagttgagtcatatcctgtgaatctaaagctacgttatttaaacatcacgggttcttcttactttcattccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagatgtgggatttctccaggtgaaagtcatcagagcggaagggttaatggctgccgacgtcactggtaa

SEQ ID NO: 3957 - DNA, 3159 bp, Homo sapiens
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaa

SEQ ID NO: 3958 - DNA, 2629 bp, Homo sapiens
acacactctgctacattgaaactgctccctgaatcttttcctccggtaaattgtgcttcctgggaaactaagggtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcag

SEQ ID NO: 3959 - DNA, 2158 bp, Homo sapiens
gcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggccttgtatgggactttcattaatgtctgagcacatggaacaaagagtgtctacgtccctttgtgttgtaagttaccagaaagttaggcagcctgcttcccatagacgtgttgttgtctccctaaagaaagcaattgtcattatcgttaagttttagaaaaaaaatctctctctctctgtctctctcagtattctttttgtagctctttcttataataaatatatggtggtactattaag

SEQ ID NO: 3960 - DNA, 483 bp, Homo sapiens
cctgttgtggcttttgccatgaggaagaggttgactactaacactgcatgtttgatttagcaggtgaagtttttagtatttaattcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacaca

SEQ ID NO: 3961 - DNA, 5396 bp, Homo sapiens
atggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaaggaactttcagaaaatgaagtggttggatcttatttctctgtgaagtctctcttttggaggacgtgcggcaggccagctcttcctgtcctgggcttctgcagagcagagcttcagaatccttattgcaaaaatgtacaatttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtgctctttctctttgttgtctggaactttgagctctacatgataccactggttttgttgttactattgacatggaactacttcttgataatatcagggaaagataacaggcaacgtgatacagtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgtaaatgtcgatttgattttaaagtttttttttaatgcgactattttttatctgaaaagtaatccattacacttttctatgttttatacatttcaaaagggagggaaattccaaagcctgaataatggaatggatacatttcaatttaacatatattctggctttagatcccgacattcactcctgtgcaaattacttaggtatgacttaggctaattttaagctaataagtgaaggtacattcactccctcaagagaatcaatactcagaaggttacaaagttttctttatagaatttcaatcaatcattccatctaaaaccttaaaatctctacaggactacataacataaatactgccagtttataaacgattgcctatctgaatttttatacctaccactactttaatttatacagttagttagcaaattagcaacccagtaagtacagttatcaaaaatactaggaaactatatccatatcgcttttggtgtcagattgtatctgtgcatctaaaaatattttaataaatactcaagtgctctcagagaaaaaaaaaacctgctttctcattagattactgaaatgctttaattcatactatgattttgttattagtgtgaattttaatgtagagaattcagtgtgctaagtgatatgccagtgtttcactacattcatttattaaaaaaaatcattcttgattatgcatgaaaacctgttttgtaaaataaaataaactgcttgggggtggtggttgcctttatcaatgtttcactattatcatagaatctatacttaaaaattgcattcccaagactcttaaagtagtttttatatctcactccctggtatactaagggagcataactctggagaaaaaataatttggttggttgagaatgtcttacttccctgacttggtaggggactacactcagttgaaattgcagcagacaatgctttgcactactttattaataataaacttggatggggtaaaagtgggggttatactggaaaaactatagaaaagctaaaagaaatgtatatttcactctaaaggaagattctttaacaataaatgtaatctcattgaagctgatttttaaagtatttttattttagagataagttgttaaatactatttcttataatagaactattttgatctgtttatatactatgcttgaatgtcaattaaattccctttctacagaaaggctttgacctcaacatgctttatttaatgtatcatgtttaaaatgacatgcttctgtctgcataccatcactgtttgttgctaaaaacataatgttccatgaacatgatgttactacagaaagtttattgatgagataactgtttgaaataactttcaattataccttatgtgagacttttatgttctgtgctgacaatgtgtactcaaatgtctataagcctgatattctacaacctcagatgtatctagtggatagtaaccattaacagatgactaatttgtttcactgtatcaaatttcagatgtttagttcaatggtaatgctgactacacattcactgtattaaatacaaaagaaaataatctttcccacgtataatcagcactccttttttttttttttttggtggttcagagattgatgagggattgtgtgcatattcttaaaaactatatgtcacttggagaaaaacagatttggtttaaacaaataagacctttttcctgaaactctgactcttatatgaaaatacctctggaggggtgagcaaccaatgacattaacagaggaataagaactagcttgaggcacaaaagtgatattcagggaaatcttcattgcttttagaaactactacattcacaggctgaaaacagaatatgtatagttaaaattttaactatttatttctttccccttctcacatagctgcaattctgtcttgagagctgcctgacttgccttcattttgagatctgtgatgtaaatatttcttaagagactgaatgtcactcaaacatctacttggactg

SEQ ID NO: 3962 - DNA, 2222 bp, Homo sapiens
gagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcgcaccgcaaagaggaaccacccctgtctatgaaatgtacccttttctctggtgacattggcccatccttatga

SEQ ID NO: 3963 - DNA, 3965 bp, Homo sapiens
atggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttc

SEQ ID NO: 3964 - DNA, 7454 bp, Homo sapiens
gagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttcaaacaaaatgtttacgaaaaatgccaaagattctaaatcttatcatcccgtgtctgtttttcttcatgttgtatctcactgggttgctttctggctgagccagaattctgcatgatttgatttacttcaagttaatgaagctggctggaaaagagccttgcagaaattataaaagctccagtaaatctcgtagttgtacatacaatagatacccaagaacctcttttgttaaaccagttactcaatcttctgtgtaaacaatgcctcattgtcttgcttctaactatcatctagtttatcatagtctgtcattttgtaacgacctaagtcagacatttttaaacagacatgtgagatctgatcagtcatttgaatgaaaactttcagcagcaaaataaccccttatttatttaaaagtggaaccaatactttattgttgttcttttgctatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattatgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgc

SEQ ID NO: 3965 - DNA, 1422 bp, Homo sapiens
gatgcccccgcccccgccgcgtcagggttgctccctgcgcttccgagtggcgactgcagcgggtccggtgcaggtgaggggcgcgcgcctgcccagctttgcagcccccgaacgcggcctcgcacaggagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtct

SEQ ID NO: 3966 - DNA, 5981 bp, Homo sapiens
ctccggtgttgatgcaaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaacagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 3967 - DNA, 6032 bp, Homo sapiens
ctccggtgttgatgcaaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 3968 - DNA, 5812 bp, Homo sapiens
cagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 3969 - DNA, 5978 bp, Homo sapiens
ctccggtgttgatgcaaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccagatggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 3970 - DNA, 2686 bp, Homo sapiens
gaggctggccagaggaggaaaggagaataactcagttttagacagggtctcgcactgtcacccaggctggagtgcagtggtgcaaccccacctcccgggttcaagcaattctcatgcctcagcctcccaagtagctgggattacagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccct

SEQ ID NO: 3971 - DNA, 6032 bp, Homo sapiens; identical to SEQ ID NO: 3967

SEQ ID NO: 3972 - DNA, 6208 bp, Homo sapiens
ggcgctggcccagggtcttctccaggctcacatgcttgctggaggctccaggcgggtggggagatctgcagggtccctttgttcccgtccggccaggacagtgtccagtggcacgagttgccatggggactgccatctgctgtgtggatacccatcggaggggcccagggtgagcgactgccccaaaggcccagcctgccctgagccctgaggccagctggtcggctttccctgccattatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagagaggctggccagaggaggaaaggagaataactcagttttagggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaacctc

SEQ ID NO: 3973 - DNA, 6032 bp, Homo sapiens; identical to SEQ ID NO: 3967

SEQ ID NO: 3974 - DNA, 3339 bp, Homo sapiens
gaataactcagttttaggtaagcctcccctatatcctagaataacctgcctcttcggctgggaagcggagggaaccttctcttccttaaagacagggtctcgcactgtcacccaggctggagtgcagtggtgcaaccccacctcccgggttcaagcaattctcatgcctcagcctcccaagtagctgggattacagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcag

SEQ ID NO: 3975 - DNA, 6126 bp, Homo sapiens
attatcccccgagccaggccggagtggggctcccagaggagctctcggctctaagtcccagcccctctcagaggaggcgtgcggccgaggttctgcagccagaggcttctcggctctgagctccggagccagatgtaacattgaccttaaatggtaaaagctccccagagtgaagagaggctggccagaggaggaaaggagaataactcagttttagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaa

SEQ ID NO: 3976 - DNA, 2887 bp, Homo sapiens
aaactcaagccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatca

SEQ ID NO: 3977 - DNA, 2468 bp, Homo sapiens
agatgtaacattgaccttaaatggtaaaagctccccagagtgaagagaggctggccagaggaggaaaggagaataactcagttttagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagaagggggatgaggccgacgtctcttcacctcaccctggcgagcctgagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggt

SEQ ID NO: 3978 - DNA, 2958 bp, Homo sapiens
actgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcaaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggta

SEQ ID NO: 3979 - DNA, 5563 bp, Homo sapiens
aggactggtccagccctcccaggcaggtgtagggccgactgcagcaacagcggccctgaccccagctcccatggctcccctccccccgcactcccaccccccgcacccggcacacaccatctcccagtcacccagtctcgaccggttctcgcgagatccgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcaaggctttggagattcctttggtagacttggcagtgcaatgattggagggtttgcaggaagaataggatcttctaacatgggtccagtaggatctggaataagtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 3980 - DNA, 5331 bp, Homo sapiens
tccgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaagggtaagtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcaaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaa

SEQ ID NO: 3981 - DNA, 731 bp, Homo sapiens
tgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggt

SEQ ID NO: 3982 - DNA, 5010 bp, Homo sapiens
agcgagggccggagtggggctgaggcttcggtgcagagctggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaattgtgttgtgtgctcattttgaccagaatagaaaaagagatatgcctttcactcatatcattccagctacacctgccttcttttcttcaaaaatgccgtccgtgtgcctgcttctgggcctttgcacatgctgttccctgggcctgaagcatgccttctgccaatattcctgtggtttgctctctgacttcctttaagcctctgctcaaatgttacctcctcagggagaccttctgtgatatataaaagagcaagccccccaccccaccgcctcagccttcctggccccctcagttctgctctagttactctatttctctccctctttcccagtacacacttgtctgttctcccgcattagaacatagttaacaagagaccagaaccttgctgttttgttcactgctccgtctgcagtaaagggaacagcacctggcacttagctgctcaatacatgttacgtggatggatgagtaggtggaagcattcatccattcagcaacctacactgagaacaatcctgtgccaagcactgtgctaagcataaggaaacaaaacaagacaaagctcctcaaggagcttgccacagggtggaggtgacaggtgacatgaatggaagtaactagtagttaccaaatacttggtgtgagccaggcactttgcatttctttctctattatttctgtgagttaacagtaattgtactaatcttaatcccattgtttgaaagattatatggcttacccagggccacttagctaataaaggaacagagaagaggggctgggcctggggccgctgtttgatccacagccttgttcctaaccactatgccctgtggcctctcacaccaaaaggaagtaccaaactgcttccttactcaaataaatgtgctgaaatgcagttgcagttttctcccagtcccttaggagctggttagagagtcccttaggaacttgagagggtagtgtagtctaggtggtaggcacagatgtctgagagctttaacctcagtctggaagacaatgtggtgacttaatttgttgagaactatgttacaaataatgtgttactaataaaacattgaggcttcgca

SEQ ID NO: 3983 - DNA, 630 bp, Homo sapiens
atggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggggcccagtcatatatgcacagttag

SEQ ID NO: 3984 - DNA, 3421 bp, Homo sapiens
tggagagccgcggctgggaccggagtggggagcgcggcgtggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgcccagactagccttgaactcttgggctcaagtgattctccctcctcagcctcccgagtagctggaacgaactatagttgcaccactgcagctggcaagaatcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttc

SEQ ID NO: 3985 - DNA, 6680 bp, Homo sapiens
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 3986 - DNA, 6719 bp, Homo sapiens
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 3987 - DNA, 763 bp, Homo sapiens
atgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggtaagctgacccttctgaaggcccagccacccccagggggaggctgctaaagacacacaggagagtgtctggagaaaccctgccattgatcacaagcctgtagctccctgcccacccagacaggggccccgagaggcaggtggggctgcctgaattgggacattgcaattgtttatgaaatgcccttcaaggtagaggggaagggtgaaccaaccctttactgaacaacctcacggtgagcacaaaaagcacatgccggctccagcagaatgtcccagggctttgcttcaggtttgtggcttccaccccatacagtgtctccaggctgtt

SEQ ID NO: 3988 - DNA, 1519 bp, Homo sapiens
gccctgggagaaatcctcccttcactgggagagaacttctctcccagggcggtgcgacccggagctccagcgccctagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactggtgagttgaaaatacgtatgtgtctaattcaacataaaataaacattggatattgtgaaaca

SEQ ID NO: 3989 - DNA, 6842 bp, Homo sapiens
gccctgggagaaatcctcccttcactgggagagaacttctctcccagggcggtgcgacccggagctccagcgccctagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctagtgagtattgaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 3990 - DNA, 6812 bp, Homo sapiens
gccctgggagaaatcctcccttcactgggagagaacttctctcccagggcggtgcgacccggagctccagcgccctagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatgtattggatgaagaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagagatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 3991 - DNA, 1130 bp, Homo sapiens
gtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtgcttctgaagcc

SEQ ID NO: 3992 - DNA, 1658 bp, Homo sapiens
ctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctggcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtgcttctgaagccccactgggtgttactgcagcagggcgtggcccaggccgagggatggtgccagcagggtggaggccaagtcccaggctttcaggtgtgtgtgtcccaccacactggccgtggtaaacatctgcccatcctcccagctcctgtgtcagagcctgggggacgagtcacccagctcacccccacatgctcaaaacagtcaccaagtcctctgggctccgtccccttaaaaaataccccaatagctaaaataatacattcatagaaaacaacaaaaaacaaatgcaggctgggcacagcggctcacacctataatcccagcactttgggagggcgaggtgggcggatcacctgaggtcaggggttcaagaccagcctggccaacatggtgaaaccccgtctctactaaaaatacaaaaattagccgggcgtggtggtgggcgcctgtaatcccagctattcaggaggctaaggcaggagaatcgcttgaacccgggagacaggggttgccgtgagtcaagattgtgccactgcactccaacctgggtatcaagagtgaaattccatctcaaaaaaaataaataaaataaaataaaacaa

SEQ ID NO: 3993 - DNA, 1021 bp, Homo sapiens
ggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggtccccaacctgccctgtccatccccctcccagactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaagga

SEQ ID NO: 3994 - DNA, 918 bp, Homo sapiens
ggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcaccc

SEQ ID NO: 3995 - DNA, 3492 bp, Homo sapiens
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaagaggaaggtgcttctgagcaaaaggacagaatttacaatgtacccttttgtatttatacaggaggtgtcagatttttttttttgtaaagggctagagaataaatattttagaccttgtgcaccataagatccttgttgcagttactcacctctgctgttataatgtgaaaaacagctgtagacaatacaaatggatgtgactgtattctgataaaattttatttacaaaaacaggcagtgggccatgtttggctcaggagccatgattgctcactcactctatcataaaagcaaaatatttgtggttgccatcatgttttatgaatctgtgaaatactttgatgcttgtacatatttattaaaagcaagtgtaattcataaataataatttttatttgcaggtactttgcttatagtatctaattcaattttcgtagcatcaaaaagctcccagttgaggaagatggtgaggtctgttgtagaatgtacacaagcagagctgagtctctgagaccactaaccaggtacagtcagggagcttggagacagctcatagagacacacagcaaatacactcattagtgcctaagattagaagtaaagtctacttcactcaaaaggaggcagaaaaaaaaaaaaaaaaaa

SEQ ID NO: 3996 - DNA, 6874 bp, Homo sapiens
ctgcgctcggagactttcagtgaaagcagaggagagatttccaaaggttgtattttccttctggttggagcctctcatccacattgtggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtgttcttctatt

SEQ ID NO: 3997 - DNA, 6775 bp, Homo sapiens
caggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagcagaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcactgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaac

SEQ ID NO: 3998 - DNA, 3121 bp, Homo sapiens
gagtggatttgacctcactgcgccagatgaagcttcagagaccaatgagtatgttaacagatgtcttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtaaattcttctgctcttaaaatcgtcgttctcgctgctgttcagtgcagtgtactgacactgacactattgtagcaagggtcttctgttgtcttttttggcactgcttttgttgtttacttttttctatctccaataaacaaaatattctgggaaacaatgaaatacactgacaaagctcacataaaaaataattaaactgtactgaggacagtatcttggaaaccattctcatgttcctttcaaagtgtggctttccttggattaaagttttgtaaaatgattgcatgtgatatttactatttattatttaaaaggagaatgtatgtaagtgattatttccccttttatatatgaacaaaatattatttagatcagtggttggcaaactacactcatgggccagccaaatccagcctaccacctgtttttgtaaataaagttttattggaacatggccac

SEQ ID NO: 3999 - DNA, 2946 bp, Homo sapiens
ctgcgctcggagactttcagtgaaagcagaggagagatttccaaaggttgtattttccttctggttggagcctctcatccacattgtggttgctttcagctatgtaacgtttttcgatcccatgagatggaaatcgaccagtgcttgctagagtcccttccccttggccaacggcagcgtctagtgaagcgcatgcgctgtgagcaaatcaaagcctactatgagcgcgagaaggcttttcagaagcaggaagggttcctgaaaaggctgaagcatgcgaagaatccgaaagttcacttcaacctcacggacatgctacaggacgcgattatccaccacaatgacaaagaagtgcttcggctcctgaaggagggggcagacccccacaccctcgtctcctcgggagggtccctgctccatctgtgtgctcggtatgataatgccttcattgcagaaattctgattgacagaggagtcaacgtcaaccaccaggatgaagacttctggacgcccatgcacattgcctgtgcctgcgataaccctgatattgtcctgcttcttgtattagctggagccaatgtccttctccaggatgtgaatggaaatatcccattagattatgctgtagaagggacagaatccagctctatcctgttgacctatctggatgaaaatggagtggatttgacctcactgcgccagatgaagcttcagagaccaatgagtatgttaacagatgtcaaacacttcttatcatctggaggaaatgtcaatgagaaaaacgatgaaggagtaaccctgttacacatggcgtgtgcgagtggctacaaggaggtggtgtctcttatcctggaacatggtggagacctcaacatagtagatgatcagtactggactcccctccacttggcagccaaatatggccagacaaatctggtgaaacttctcctgatgcatcaggcaaacccacacctcgtgaactgtaatgaggagaaggcgtcagatattgctgcctctgagtttattgaggaaatgctgctgaaagccgaaattgcctgggaagaaaaaatgaaagagcctttatctgcttctaccttagctcaagaagagccctatgaagagatcattcacgatcttcccgtactgtcgagtaagctcagtcccctggtgttaccaattgccaagcaagacagtttgttggaaaaagacattatgttcaaagatgcaacaaaaggtctgtgtaagcagcagtctcaggacagcatccctgaaaaccccatgatgagcggttccaccaaacccgagcaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaaataggagatgtttt

SEQ ID NO: 4000 - DNA, 2933 bp, Homo sapiens
agtagagacgaggtttcaccgtgttagccaggatggtctcgatctcctgaccttgtgatccgcccaccacagcctctcaaagtgctgggattacaggcgtgagccaccgcgcccggccctcctttgggtcattttttaaagttaatgattccctgtaccaaccccttattttgaaaaaatacctcttcattcaagtttcaagaaggtgttgatgcaggattttgctccttagctcggctacgtccaggttcttgcctcacgacctggaaaaatgaggcgtgcggacacgagagatggagaaaggggatcaggaaagtctgaagccagcaaacaaatcataagacacctcacctgcagggctggcgccagcagggccacactggattccagattcaaacatgtcgtgtgcatcttagaagcctttggacatgccaagaccacacttaatgatttgtccagttgcttcatcaagtattttgaactgcagttctgtgagaggaaacaacagctaaccggagccagaatttatacatatttgctagagaaatccagacttgtttcacaacctcttggccagagcaattttctcattttctacttgttgatggatgggttatctgctgaagaaaaatatggacttcatcttaataatttatgtgcacaccggtatttgaaccagaccatacaggatgatgcatccacaggggagcgttctctgaacagggagaaattggctgttttgaaacgagccctgaatgtagttggcttcagcagcttggaggtggagaatctgttcgtaattctagcagcaatattgcaccttggagacattcggtttactgccctgaatgaggggaactccgccttcgtttctgacctccagctcctggaacaagtggctggaatgttacaagtatcaacagatgaattggcatctgccttaacaactgatattcaatattttaaaggggatatgataatacgacgacataccatacagattgctgagtttttccgagacctcttggccaagtccctgtacagtcgtttgtttagctttttggtgaataccatgaattcttgcctccacagtcaagatgaacagaaaagcatgcagacattggatattggaatattggacatttttggttttgaagagtttcaaaagaatgaatttgaacaactttgtgtcaacatgaccaatgagaagatgcaccactatatcaatgaagtgctttttctccacgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaaggtcagccctggggagggacccagcctcgtgttccgggctcgcgcatgctctgacttcgccttggggcgcccatggcagtactgtcgccctaatgtattcttaatagaaataaatccaattgttggcttgccagcagctctt

SEQ ID NO: 4001 - DNA, 1009 bp, Homo sapiens
ccatagcctgcctgtctgcatggtccgcctagaggtttgagcagctgggcatggaagaagcgagccacacccccatcgcatgccctatgaacgggataagggaactttttcacttcaccactatgcctgactaattttttaattaaaaaaaatttttttgtagaaacagagtttcaccatgttgcttaggctggtctcaaactcctggcctcaagtgatcctccctcctcggcctcccaaagtgctgggattacaggcaccgagaagagctcggaaaagagcagaaggcaccgccagctccaacgtcttctccatgtttgatcagtcccagatccaggagtttaaagagagtctggctctgtcgcccaggctggagcgcaatggcatgatctcggctcactgcaacctctgcctcacgggttcaagcaattctcctgcctcagcctcccaagctttcaccatcatggaccagaaccgtgatggcttcatcgacaaagaggacttgagggacacctttgccgcgctgggccgcatcaatgtcaagaacgaggaactggaggccatggtgaaggaggcccccggacccatcaacttcacggtgttcctgaccatgtttggggagaagctgaagggcacggacccagaggagaccattctccacgccttcaaagtgttcgacactgaagggaaaggtttcgtcaaggccgatgtcatcaaagaaaaacttatgacccaggcagaccgcttcagtgaggaggaggtcaagcagatgtttgcagcatttcccccagatgtgtgcggcaacctggactacagaaacctgtgctacgtcatcactcacggtgaagagaaggattaggggatcacaagtctccccgacattcaggggcagcaaacactgttgtggggtgtgacagggagctcttgcagccagaggctgcaggaaaaaggcttcccttgtcctacggttggggacaaagcaagaataaataatgctaatgaggtctga

SEQ ID NO: 4002 - DNA, 4273 bp, Homo sapiens
cccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataa

SEQ ID NO: 4003 - DNA, 4210 bp, Homo sapiens
atggcggaggtaccgcctgggcctagcagcctcctcccaccaccagcacctccggccccggcggcggtcgagccccgctgtcccttcccggcgggggccgccctcgcctgctgcagcgaggacgaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtg

SEQ ID NO: 4004 - DNA, 7644 bp, Homo sapiens
aaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaatatattgtttcccgcttcctgcctttcatctaagagttacggggaagaagtattacataattgtcatcactgttgtgtgttctgacaaagtaaatttgaaaataacatgaacttgatttttctaaaagtactcagtcaactcatatgtcagttatcggtacattttccatgtgttcagtcaaaagtttatctttttagtctgtttcatagcagtttatttctaagacagtttttattttaatttacttttttgtctgtacactgccactctgtaatgttccccccaccccatcccacccttggtaagacaccaaagtaaaatagagcaatatccaaagagctttttgcccctgtcttgtgaggagctttaaatagctgtgaatacttctgtatgtcaagattttcggattttagtggaaggatgaaatgatctgttttaatcatttaactgctaaattacttttatcatgcatgccaaatctttacattattctttagagtaatactgtaaaagtatctgagtttgttttatttgggccttatgtggaactcgaaatacttcataaattcactctaaggtctaaataagaaccagaaggttgataccattttttcacaccagtaaacacagatcagtattaacctgtagcccagaggtgttagatttattttttgagacagagtctcactctgttgcccaggctggagtgcggtggcacaatcttggctcactgcaacctctgccccctgggttcaagcaattcttgtgccttagcctcctgagtagctgggactacaggtgcatgccaccacgcccagccaatttcttgtattcttagtatgagacagggtttcaccatgttggccaggctggtctcaaactcctgacctcaagtgatctgcccgcctcggcctcccaaagtgttggaattacaggcgtgagccaccacgcccagcctatgatattctttttataagcaacttttaaaaagttttttaaaagatctcataagcatatagcactgctacactttagatcactactgtccagtcacactttatataaggatagatgtgtccttttcactccccagtatggtagttactagtcacatgtgtagctactgagcccctgaagtgtgggtgggatgattgagctgaatttgtaattttaatcaaagttagccacatgtggcttgtggctactgtattggacagcagagctttagataagcagtaataacaggaagggagtgtttgtataggttgaaagataaaatggaaggatcacaattaggccagatgtggtggctcacgcctattatcccagcgttttgggaggctgagatggtagtttgcaaccagccaggacagcatagcaagactgtttctgaaaaatcttttaaaataacacaactaaaaattacctctgagcaagagtatagctgaactgtttatactgacaatatatttcattaatacagtgtttgaccactttccaccccaccaaccactgcccttgttatgtagcctttctgagaaaagcagccctttcagattttattgttggaagttccttgggttgcagagatgcagattcaagtgccaaaagttgtttctgatgagacttacctttttagccttaaaatatttgtatagttggctctaataatttctcatttttgatgaatttgaaatcatttcacttctaaatgagattggtcatctcatgagtggtcaagttggaacatggaggtctatcatgtttttaacctccaagatccacttatggggatgaggccaaaggccaatgttacttctagaagaaccagattaatttttctgccttccatcaccgcagtgtattacctttgaccctcgctggtcatctggtaagtgtagttcatcaaaagagcagaaataggcatagtaaacacctggacacaaagacagtgccaggcttggtacaacctgttaacactgttgaggaaagagctcaaaacatgcattactttggggattaagtcagtgtttaatctcaatatgaaacagacctagaaataacaaagaccactgaagtgccaaatttatcttctaatactactatttaaactatgcaatatgggggttataatgaaatagttttagtctatgtaaggtttttataatgctaagaaataagcttatttttagatatggattttttatgactacctctttgctgtatgaatatcttaattttctaatacctcagtttcatgagaactgtatgtacatttttgtaaataaaataatttaccatatactaggagaaggacctgcttttaaagaaattgtgtaaagacatttgttattggatgtgttacatagtaaatcaatttgaaatttcttaaaaacgtttataagacttttctggtctccttgaccgagggattttagtataagtatttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctccctccctccaaactgtggctgtaaacagtgactctgcatagtcagcgttatacttgatttctttgtgaatgcaaataaaataaaatttgtaagtccaccaaatattgacttaa

SEQ ID NO: 4005 - DNA, 2649 bp, Homo sapiens
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacaatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggattttttctgtgaatttagtgaacagtcaccatgtgttctttcaagatctctgttacaaaccactttcctggtggataacaaaaaggtctttggaactcatctcatgcaagacatggtgaaagatgcacttcggtcttttgtcagtcctccggtgctttcccccaagtgctacctatataataatcaccaggctaaggactgtatcgactcctttgttactcactgtgttcggccattctgtagtcttattcagatccatggacataacagggctcgacagagagataagcttggtcatattcttgaggaatttgccaccttgcaggatgaggcagagaaggttgatgcagcgcttcacaccatgctgttgaaacaggaaccccaaaggcaacatttggcctgtttaggtacctgggtcctttaccataaccttcgcattatgatacagtaccttctaagtggctttgaattggaactctacagtatgcacgagtactattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaagttcgcccattgagccgagagatcacaatgagccaagcatatcagaacatgtgtgctggaatgtttaaaaccatggtagcatttgacatggacggcaaagtacgtaaaccgaagtttgagcttgatagtgaacaagttcggtatgaacacaggtttgctccattcaacagtgtgatgaccccgccgccagtgcactacttacagttcaaggaaatgtctgacctcaataaatatagccctcctcctcagtctcctgaactgtatgtggcagctagtaagcactttcaacaggcaaaaatgatattggaaaatattcctaacccggaccatgaggttaatagaattttaaaggttgccaaacccaactttgtggttatgaagttattggcaggaggacacaaaaaggaatctaaagttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgacaaaaaaaaaa

SEQ ID NO: 4006 - DNA, 1797 bp, Homo sapiens
gcttatgcgcccagtgggaccggggctgggctgggctgacccgggcagggcggaagggaagcgtgtgcccgcctcaggtgtgcctcggccctaggcccggccggcgggaccctgcggtgcctgccggctcctcattgctcccggcgaggttctgcctgggtccgggccggctctggcccgggagaggtcccagcgagctctggccagatgaagggctaccttgattgacttcggtagctgccgcatggggtcctgggctgcgagaggggaccctgaatagtgccttggtcttttgtggctattattgaaagttggaagctctggagttgttcttttcgggccagaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacaatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggaggtctctgacatcttctagagatggaggtggaagtcagagataatgtgtaaaactgaaaagaaacgaaggagtactctaagcttgttttttgccaatgtgtagatcagaggtgtccaatcttttttttttgagacgaagtttcactattgttgcctaggctggagtgcaatggcgtgatctcggctcaatgcaacctctgcctcccgggttcaaatgattctcttacctcaccctcctgagtagctggaattacaggtgcctgtcaccatgcccggctaactttttgtattctttttttagtggagacggagtttcaccatgttggccaggctggtctcgaactcctgacctcaagtgatccgccctccttggccttccaaagtgctgggattacaggcgtgagccactgcgcctgaccggggtgtccaatcttttggcttcccagggccaccctggaagaagaattggtcttgcatcacacataaaatatgctaatgagagctgatgagccaaaaaaagaaaaaatcaccaaaacaaatctcataatgttttaataaagtttacaaact

SEQ ID NO: 4007 - DNA, 690 bp, Homo sapiens
gagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagagatttcgcggctcctagaactgattgattttcatgaatataattttaaaaatgaaaatgttcaatgttggaaggaatg

SEQ ID NO: 4008 - DNA, 1313 bp, Homo sapiens
ccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgctg

SEQ ID NO: 4009 - DNA, 2184 bp, Homo sapiens
atgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaagtcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtga

SEQ ID NO: 4010 - DNA, 1379 bp, Homo sapiens
atcagcaggctcagcagaggtgtgtcctgccctgcgcatgagtcagcacataagtagttaagctggcgaggcttgggcttccctggttagagtgtccagcctcccagagttaacctgcagcactgctcagaagagcaggggcagaggataccaaagcgtcccagcactctggcttgcaggggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttcctaactcaggattacactgaagtgaacccgctggggtgcattttccagaaaagggccaagaaaaggtagcaagaaaaataccaagtgacagaaagctcaaacacaacaacgagctatggaaatacaattggccagggtgtgtggaacagcctcgagactgcccactctgcctgggatgcactaccccagatctctgcacagcttggcccgcccatctcaccccggctcaaatgccggcactgcagtgacaccttctctaccagtcctgcctaaaggagcacctcccagccctacccaccactctgccccagggaagaagagacagcagctg

SEQ ID NO: 4011 - DNA, 4797 bp, Homo sapiens
atggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgagagagagagagagagagagagagagagagagaggtttgtcccatatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgttttcctaagtgtccttatcccactggattgtgtctcttactcccaagacttattccaaatgattttttgactcttttcattaatcaaattcaccccaaaccagaaagttttgccattagtgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaagcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacagtctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtattttaaaaataaactttgaggtttgaaaataataacaatattcataatggtagtattaacatctattatgtataacttaatctcaacataatttattgaattagaatgaacctggaacactttttgatgaattggtatcctagaggctgtttccttgggcattaactgctggaggattaggtaatcagggattccaagtgttgtgatcttttttctgatgatgccacagtcttcagtgtaaaagttcagaagcctaaaagaacaagtgatcctgaaagtagctgattccagacaagaaaattatattagaacttatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatcctactgcacctagcactcttggctccagataacgcacagaaacctattttctcaccagctgtcatttcttctagggcatgcagttctatgttcgcagttcatgtgtaaaaataaaaccaaattcctggattatcaatatcagttctttacctgtgcataaaagaatatcatgaagtaattgaacttatctgttgatataaaaacacagatccaattcatgtctgtggatgctgcagggactggctcactggagccaaaccatgtggcagaaactcctgaaattggtggaaaaagtggaatatggcagattgggtaggtaggagaacaattttggagattttgtttctcatgttaaaatgtctgcattttatttgctgtaccctgcctactctggttttaaggattttttgacttctttgaaaagcactgaataatctcttttccaggtctagattttttgatgagtactgtgtaaaattgtcaatattcaatggattatttaataataaattaagaattacactcataaaa

SEQ ID NO: 4012 - DNA, 1942 bp, Homo sapiens
atggactctgagaaatcttctgagtggcggagtgatgtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtg

SEQ ID NO: 4013 - DNA, 2311 bp, Homo sapiens
atggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaagtcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtg

SEQ ID NO: 4014 - DNA, 2507 bp, Homo sapiens
ggtgcggggaggtcgcccccgggcggcgaagcagccattatgcaggccttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaa

SEQ ID NO: 4015 - DNA, 2243 bp, Homo sapiens
atgacttgctaccgaggcttcttgctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacaca

SEQ ID NO: 4016 - DNA, 3614 bp, Homo sapiens
agatgccggtcctgcctctctcgcggcccccagcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggctttttttttttgatatacataagataccactttataaagaagctccatactatagaacctcccctaacaggcttaaaataccttctttttttttttttttttttttgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgttacctcttctttttaacatttcttatttccctctcaaggggtcattatttgaaaactagttttcacaaaatgttatgtttcagaagtgtttccccactgctgtgtattattattctgtgccctgttgacttcattcactgttaacatttgacatagaatgattagttattaaatcagggtgaagtgcttacctggtcagtgtaggctcttcagataattttgacttaatatttttgatactccttgtgcatttacattcatggcccctgtacattaaatcatattacatgtttta

SEQ ID NO: 4017 - DNA, 1437 bp, Homo sapiens
atcgcctaacagaattctacctctttctcaggccgcagccaatggcgcggcccctcggatccggagccgccgcgggctctgattggccgatagagttagcctgggggcgggagaagagcgacctcggggaagcgtgtggtgcggggaggtcgcccccgggcggcgaagcagccattatgcaggccttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagaatgtcttattcttgggctgtagcagtggacaatttaagaagaagtatacccactctaaagggactggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatag

SEQ ID NO: 4018 - DNA, 1233 bp, Homo sapiens
atgacttgctaccgaggcttcttgctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccaggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtga

SEQ ID NO: 4019 - DNA, 487 bp, Homo sapiens
ggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgact

SEQ ID NO: 4020 - DNA, 635 bp, Homo sapiens
ttctgggcgtgggcttcctgcggctgagtggcagcttccatccggtgggttttgctcggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaa

SEQ ID NO: 4021 - DNA, 581 bp, Homo sapiens
gctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagaca

SEQ ID NO: 4022 - DNA, 654 bp, Homo sapiens
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatcggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtc

SEQ ID NO: 4023 - DNA, 963 bp, Homo sapiens
gtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggactacaggcacttgccaaccaagcctaacatgttttttctttttggtagagatggggtctcagtatgttgctcaggcaggtctcagactcctggcctcaagtgatcctcccacctaggcctcccaaagtgccgggattacaggcatgagccactgcacctggccagcctcacagttcttgtctg

SEQ ID NO: 4024 - DNA, 2130 bp, Homo sapiens
agatctaagcaggcactattaaagacagtcgcatccgggccctcctgccgcaagctgccctcccagccaagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtgcaggttttcttttcttttttcttttttttttttttgagatagtctctgtcacccaggctggagtgcagtggtacaaacatggatcactgcagcctctacctcccgggcttaagtgatcctcctgcctcagcccctaagtagccgggactacaggtatgtgccaccatgcccagttaatttttgtaattttttttagagacagggttttgccatgttgcccaggctggtctcaaactcttgagctcaagcgatccattctcctcagcctcccagggtgctgggattacaggcgtgagccattgcgcttagccatggtgcaggttttcaaaggccaggaagtatattcataattttaagatggggaatatagcaagttttcacataggtgtgtgtaagtcatcacatcatagaaacttgaggaattcagtgacattaattttggattttcatacgtaagtatacaattaaatgtttacagggtagtagaagcacattttaaatgtcaggaactgaactaagtatttgaattacgtggattatctcaaaaattttgaaattgttaaacgagttgaattacttgaattcattctgttagtcaaatggtggatatttacacccatgtagttttgaatttagagtgtgtagagtgttttcagttaccagactccatgcttttacctcctatgtgtcaggtataatttgaacctctaagaacagggtttctcaaccttgccactgttgactatttctgaaagacagtttggtttagcagaccatcccatgcgctttagcttgtttagtagctaacttgggctctgccactacagacaaaaagcactctttccctccaattcccacaggctatgagaagaatggagacattaccaaatgtccattggtgggcaaaattgcttcattcctacctctgttgagaattactctagatcctttggcacaaattacctcaaagtttaaaattgtgtaaacaaacagtgtgtcatgtaattgaaaaacattaagcaactccaaataaatgctacattaagaa

SEQ ID NO: 4025 - DNA, 684 bp, Homo sapiens
attccagtagcaattttcataactctggtgaatgtattcattggtcaagctgaactagcagaaattccagaaggctatgtcccagaacactgggaatattataagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtt

SEQ ID NO: 4026 - DNA, 528 bp, Homo sapiens
gtgctgtcggaaggcgacggcggtcacgcctgcacgcctcgtctgtctggagcgaaattttattcagaaattattggtaatgtttggaagctaaaaaaaaaaaaaatgagaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 4027 - DNA, 472 bp, Homo sapiens
ctacgcccacctaatttttgtatttttagtagagatggagtttcaccatgttggccaggctggtctcgaactcctaatctcaagtgatctgcccacctcagcatcccaaagtgctaggattacaggcatgaaccaccgcacctggcccagatgcaatttaaaagctatttcaaaaaaaaaacaaagcagttgtatttctgataatttttttttcttttagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 4028 - DNA, 458 bp, Homo sapiens
cgtagagatgtgacccagtgaccgcccgctaaccggactggagagaagaccggcccggatcccacgcctggcctgaagcagggaagacgctgcctcccctccgcgagcagcttacattcgtccaagttccagccttctgtcttctcgctaacctcgctctcttccaaatcgcaaatcctcttgagccgacaccgttgcgcctaaatgatctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctg

SEQ ID NO: 4029 - DNA, 656 bp, Homo sapiens
ggcggctggggaccgcggggcggacgggagcgagtatgtccgctctgactcggctggcgtctttcgctcgcgttggaggccgccttttcagaagcggctgcgcacggactgctggagatggtggagtccgtcagaactgaggcccaggaaatgaaaggagtgacttgcctgaagtcccacatggatgaagaatctggagctggggcaggtgtggggtgggcagaaggcaaagccctgtgtgacttgggcaaagacagtgatggagagccatgagcgacagcccttggtcctgcatgaggagatgggggaatgccgatcttccctgagtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatg

SEQ ID NO: 4030 - DNA, 504 bp, Homo sapiens
cgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgagaa

SEQ ID NO: 4031 - DNA, 726 bp, Homo sapiens
tccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaaggtctcattctgtcatccagactggagtgcagcgtgatcatggctcactgtaaccccaacctcctgagctcaagtgattctcccgcctcagccttctcagtagctgggactactactcttggctaatttttgtatattttgtagagatgaggttttgccatgttgcccaggctgatctcaaattcttggactcaagtgatccacctcttggcttcccaaagtgttgggattacaggtgtgagccagtgtacctggccaacaaatttgttttaatgactggactgtaaacccttgagagaggaagggtgattttgcttctcttgtctacaaggctgtcacatgatcagtgctcaataaatacttgaataattgaataaatgaa

SEQ ID NO: 4032 - DNA, 1101 bp, Homo sapiens
agcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagtgggtgtgctccaaatttctttatgtcatatttaccttttttcataaacattagtttttactttgtgcctatgatggacttgaaaaaactgcatattctaacagcatgaagttgagttaaccatgtcctgtatctgcttttttttttttttttgagacagagtcttgctctgtcgcccagactggagtgcagtggcgtgatctgggctcactgcaacctctgccttccaggttcaagtgattctccttcctcagcctcctgagtagctgggattataggcacatgctaccacacttggctaatttttgtatttttagtagaggcagagttttgccacgttggccaggctggtctcgaacttctgacctcaagtgatctgcccacctcagactcccaaagtgctaggattacaggtgtgagccaccacgcctggccatgtatctgatttctgccttaagttttcacatttgctttggtctcttcttccttttcattgtatgttttattttatttacattttttattttgtagagacagggtgtcactatgttgcccaggctggtcttgaactcctgggctcaaatgattctcctgcctctgcctcccaaagtgctgggattacaggcatgtgccaccacacctggcccattgtataataaaaaaaaatttttttcctaagttaggttataattttaggg

SEQ ID NO: 4033 - DNA, 1666 bp, Homo sapiens
gcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagtgggtagctagcaacatggaccacagatatactggtgactccgctctcctctggccaagctacaaatcatcacctgaggcagagatgctactaccctcttctggggctcaactaccgatgggcatcagtaatccatcccagtataacatttcaaggatgtgctggagacaatacatggactttctctttcaatggtgaggaatgaaacaagatacaagaaccacagcatggaatatgttttcttttacatccaatggccaggtcataaaggatgccttgagacctccaccctggcccccacagcgctttgggacaggatgactaacgcagtccagcttcatgtgcaatcaagtcccgggaagaaatttacatttcaaactctgaaaaatcagtgtctaggttggcagcagtactctggaaactgataaaaccaaattcggtcctatatttcaatttccccttctaagttaatacatgattgctgcccatcatacagtacttcaaccctaaactacagcaatttctgtcaacatttctgttgtataaaagttccatgctttgaagagcctatgggagtagaaaaagtttctctagaaatgtcactgaactatatttgcaacctagttgctctatgtgataaatatatctgactatactagggattatgtgctttaaaaaaataattttgttcactgaaaatttacctgtgtgttttctcattgttaaatgtgattttggctataaactctttagtgcatttacctatgcagtctaaattgcactctaaaaattattaacacagctgagttaaaccagagtggctgctctcttcacaaatcactgatttctgctaaaatgttagcttttttattgcatcatgaaggcacagtaagatcatttggcaaattgtcaaggtatttttctagagcctcacctacaccatttcaactcatgacctgtaagctatttgctgttcatactcacagtaaaccttccatctctggctatggtgtttatagcctaatggttggaatctgctcgtctcaaggtgctggtattcctagcactaacaatgccaacttggacaaagaagagaatcttgcaaaaagagtaatcattctaccctcttagctgggtggtctttctatgaatgcctgtgcatgtgacaaagctgcagcaaactcattatgaggatgtactgtcatgccaagcctactgaaaattaaaattacatcactgttagt

SEQ ID NO: 4034 - DNA, 671 bp, Homo sapiens
gacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaagtagtagtttctctttcttagtattaccttgattcaatgttaaaaactattaacaccctaacaacacagaagcagacgcagcccgtgttgggaatctgctgtcagagtgacagcaaacatttgctgtacattgaatgaatgaacataaacttcattaaactgtgagctctta

SEQ ID NO: 4035 - DNA, 1426 bp, Homo sapiens
gcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatatatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatca

SEQ ID NO: 4036 - DNA, 1141 bp, Homo sapiens
atagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagt

SEQ ID NO: 4037 - DNA, 4046 bp, Homo sapiens
cttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttataatgctttcatggtttttttttttgccatgtattgttcttttttaaactacacacagacacacagacacgtacacacacacacacacacacacacacacacacgctcttttcctagatgcaatctctgggatcccttagagtccttttttggggaagtagttgcactaggtaatgtgattcctgcagagattataaaatgtgagtaaaagctaaaaatgactcatttattaagcatttattgtctgctagacactatattaaataactgcattttttaacattattttcttttctttttttttttttttttttttgacgaaatcttgcactgtcacccaggctagagtgcagtgccgtgatctcggctgcaacctccgcctcccgggttcaagcaattcttgtctcagcctcccaagtagctgggattacaggcacccaccaccacacccggctaatttttgtatttttcagtaaagactgtttcgctgtgttggccaggctggtcttgaacttctgacctcaggtgattggcctgtctccacttcccaaagtgctgattacaggcctgagccactgcacccaacattattttcaaaatgacaagaggtagtatttagtacctgaggctcagatgttaaacacaaactcagtatttacaaaaataaacatttaaaacatttacacttcaacttccaaaatggctttttaccataaacattcaggattttcaaacctgtaacagcttatcaatgcatctcatcttagaagtatgttttacattcttcataaaaataaaaatgaacccaggcttcctaagattcaggccagtgggtctccacttaaggccaaatggagaaataattttttgctgcctaaacacacaagtgaattgaaaagccacaggccattcattcaacaaataactttattatttttattgataatgtacttgtaatgtgctattttgatacatgtatgcaaagtataatggtcaaatcagggtatttgaatatacatatatttcaaaatatagttatatatttcaaaataagatatagcaagttagaagtatatataagtatattattatatgttattgttaactataatttacctactgtactatcaaatactagaacttattccttgtatctaaatgtattcttgtaaccattaactaacttttctgaatttcctactctccccttcccttcccagccttgtaaccacctttctactctgcctccatgagacccattttttaatctcccacatatgagtgagaacattcaatatttgtctttctaggcttggcttatttcacttacattaatgacctccagttccatccatgttgctacaaatgacagaatcccattctttttcataatattgtccatacataccacattttctatatccatttatctgttgatggacacaggttgcaaagggattgctggattgtatgataattctatgtgtagtttcttgaggaaccttcatggtgttcttcatagtggttgtactactgtacattcctaccaatggtggatgagcgttcccctttctccacatcctcacaagcatttgttattttttcttttttttcaaatgaacattttaactggggtgagatatcttaatgtggtattggtttacatttccctaattatggttgagcattttttcacatatctaatggccattcatatgtcttcctttgagaaatgtctatacagatctctggccctttttttaaattttttttttttttgaattggggtcacccagtctggaggtgatctgggcttccacatcctgggctcaagtgatcattccacctcaggatgacccaaatagctaggaccaaaggcgagtgccaccatgctcagctaatttttttgtattttttgtagcgactgggtttcaccatgttgcccaggctggtcttgaactcctgtgctcaagtgatccgctcaccttggcctctcaaagtgcaggtactttaggcgtgcctggcctttttgtccattttatttttttgagatggagtcttgctgtgtcacccaggctggagtgcagtggtgcgatctcgactcagtgcaacctccgcctcccaggttcaagcaattctcctgcctcagcctcctgagtagctgggattacaggtgtgcaccaccacacccagctaatttttttgtatttttagtagagagggggtgtcaccatgttggccagggtgatcttgaacttctgaccttgtgatccacccaccttggtctcccaaagtgctgggattacaggtgtgagccactgcgcccagcctgtccattttttaatcaggttatgggttttttgctattgaattgtttgagttccttatatattctggttatgaatcccttgttagatggtgtgttaggccattcttgtgttgctataaagaaaatcctgagtctgggtaatttataaagaaaaaaggtgtaaatggctcatagttctgcagactgtacaggaagcatggcaccagcattgcttggcttctggggaggcctcaaggaactttcactcatagcagaaagcaaagcaggagcaggcacatcacatggcaagagagcaagagagagaggtggaggagatgccacacactgttttaaacaaccagatctctcaggaactcattgttgttagaaaaggaattaaaagaaatcaaagagtgtgtaagcagaaactcagttgtacgtaagaaaacccaattccccctgagaaagagaaagagctggagtcctttaaaaattcactgcctgtttttctggtggctagtgagtgttagctctcctcccttcccaggcattgtgaagaccctgtttccctagctgtgcagctgcaaggtcactagacagataaactcaagtcgcaaaacatgtttttccttgaaaagtaagaaatgatgtaatgcatgtcttgactgaataactgtctttgtttcttgcttctgtaatatgcttccccctgcacagatctccccctgccccacgaaatgcttaaaagctaacttaactctttgttcagggctcagtcctttggatgttaatctgactgggccggagcacctaaataataaatattctcctgaacccca

SEQ ID NO: 4038 - DNA, 666 bp, Homo sapiens
gttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgac

SEQ ID NO: 4039 - DNA, 495 bp, Homo sapiens
ccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtacca

SEQ ID NO: 4040 - DNA, 1888 bp, Homo sapiens
aggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtatttttttttttttttttgagacgacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatac

SEQ ID NO: 4041 - DNA, 2518 bp, Homo sapiens
tagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtatttttttttttttttttgagacgacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatacaaggctttggattttttattagttctgcaataaataataggttta

SEQ ID NO: 4042 - DNA, 588 bp, Homo sapiens
cgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaa

SEQ ID NO: 4043 - DNA, 1869 bp, Homo sapiens
ggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaa

SEQ ID NO: 4044 - DNA, 1678 bp, Homo sapiens
ccggggaggggcgggcgcctgccgccagggggcgccgcggggcagcggggttgcacctggcgcttggcgcccgcacctctgcccgcctcggagaccccgcagccccgcgccgccgcctggccccggccccggcccctccgcgggatcctggcccctcctcgagcgccgccaccggccgccatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagcagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccagggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgca

SEQ ID NO: 4045 - DNA, 1464 bp, Homo sapiens
cggggttgcacctggcgcttggcgcccgcacctctgcccgcctcggagaccccgcagccccgcgccgccgcctggccccggccccggcccctccgcgggatcctggcccctcctcgagcgccgccaccggccgccatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagcagcctaagggaggccatgtccaagtggccggaggggtccctgaatggcctggactcagccctggaccaagtgcagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgc

SEQ ID NO: 4046 - DNA, 1521 bp, Homo sapiens
gggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaccctcaaggagaccttcccggtggaggcgggcctgctgcggagatctgaccgcgttctcccaaagcttctcgatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatga

SEQ ID NO: 4047 - DNA, 1539 bp, Homo sapiens
tcttgcacgcctccagggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaagaccctcaaggagaccttcccggtggaggcgggcctgctgcggagatctgaccgcgttctcccaaagcttctcgatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatga

SEQ ID NO: 4048 - DNA, 1270 bp, Homo sapiens
agccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaagaccctcaaggagaccttcccggtggaggcgggcctgctgcggagatctgaccgcgttctcccaaagcttctcggtcaggccagcctggatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatga

SEQ ID NO: 4049 - DNA, 4592 bp, Homo sapiens
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccata

SEQ ID NO: 4050 - DNA, 2155 bp, Homo sapiens
gccgctgtccccgcgccctgcgcccggtggccccccacctccgccccgcggccgtacctggcgccccctggctcccccggcccccgcgcggcgtggagccatcttccctcacctcctaccggcaccctagcttgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacagcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaatgaggccctggagtgcgcaaggagtgcccggatgcttggggtgggtgttcctcccggggcttcaaggggtgactgctgtaggctgtcccagtgcgaggccgggagcgaatggaaaagctgaggctttgcctggcttgtgcatcatgaagtgagaggggacagggccggtggggggaagcagcttgtgcttagcagggagcatccgcggctccccgcaggaggccaagcagcagaaggcagcagtgctagaaagagaagtgc

SEQ ID NO: 4051 - DNA, 507 bp, Homo sapiens
atggccggcagtgtggacaacaggcagtgtggacggcagggcaggcagtgtggacaacagacagtgtcgacagcaggcagtgtggatggcaggcaggcagtgtggatggcgggcagtgtggatgcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacagcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtga

SEQ ID NO: 4052 - DNA, 941 bp, Homo sapiens
cggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtctcagctgtgcgagaagagaagctccgctcccaggacacacagtggggacaaggctagaggagtcggcctttgcagggagctgtggagccaggcaggtcacccacagtggccaggccccttcccttcagggctggtggccgtctga

SEQ ID NO: 4053 - DNA, 1940 bp, Homo sapiens
gctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtctcagctgtgcgagaagagaagctccgctcccaggacacacagtggggacaaggctagaggagtcggcctttgcagggagctgtggagccaggcaggtcacccacagtggccaggccccttcccttcagggctggtggccgtctgactgcagacttggctaacagactggcctcagggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacagcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaa

SEQ ID NO: 4054 - DNA, 826 bp, Homo sapiens
tcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaa

SEQ ID NO: 4055 - DNA, 1937 bp, Homo sapiens
accgcgcgtgccccgcctctctcccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 4056 - DNA, 557 bp, Homo sapiens
ctcgtgccgttacggccatcacggcggccgcagtggcgtcctggagccctcctcaggtgagctggagctgcccggctcggcagcgggaagagacagtctcactgtgttgcccaggctggttttgaactcctgcgctcaagtgatcttcccatctctgcctcccaaagagctaggattacaggagtgagccactgcacccagcagcttgatgtttctaaggttcatccatgttatagcacatactggtactgtgtctggaattggtgggttcttggtctctctgacttcaagaatgaagccgcggaccctcgcgtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttag

SEQ ID NO: 4057 - DNA, 1971 bp, Homo sapiens
accgcgcgtgccccgcctctctcccaagagctacgcggcggcggcggagcgcaggcctcgtgccgttacggccatcacggcggccgcagtggcgtcctggagccctcctcaggtgagctggagctgcccggctcggcagcgggaagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 4058 - DNA, 571 bp, Homo sapiens
gcggcggcggcggagcgcaggcctcgtgccgttacggccatcacggcggccgcagtggcgtcctggagccctcctcaggtgagctggagctgcccggctcggcagcgggaagagatagggtctcactgtgttgttcagactggttttgaattcctggcctcaaacgatcctcccaccttggcttctcaacgtgctgggattatagggtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaattta

SEQ ID NO: 4059 - DNA, 587 bp, Homo sapiens
aagagctacgcggcggcggcggagcgcaggcctcgtgccgttacggccatcacggcggccgcagtggcgtcctggagccctcctcagagatagggtctcactgtgttgttcagactggttttgaattcctggcctcaaacgatcctcccaccttggcttctcaacgtgctgggattatagggtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaag

SEQ ID NO: 4060 - DNA, 2403 bp, Homo sapiens
gtttcagtgttgcagaacagacgaggaagctcactgagaattatcctgagctgtgttaacaaactgacagaacacagaatttttactcaaaatggattggttaaacgtctttaaagattttttcagcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttccagtgcttctccctcatctggttattcaagaaaacaaaacagtctctgagatatttagcttttcaaactgtaaatagatgctctagtgttatttatttttttaatcccacttgtattattttacctctagagcatcttgtattaggacatgttatatttatgccagtgggaaataagttatggccaagttttgcaaaaacaggaagcagtgagatacttgtttttttctcctcactaaatatcagtaattgtcaggaatggtattacctattttcatttcctcttttcagctttaagttttgttgattgggacactaaaactgatgtatacctgaggaaaaaatagaatgtgctcatggttagggaaaattatattatttttaattttttaatttgttttttaaccaagtaggaatttgggtgtatggataagaggccaatctgcttctgtaggctatagaagaaaaccagttgtattttatggtcataatttgtccccctattattctggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaatagatatctaatacgccagaattactgatggtaaaattgaa

SEQ ID NO: 4061 - DNA, 4720 bp, Homo sapiens
agagggtgtcaccatctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcccactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctgggtatagctgttgctccaggaagggatttctcttctggatcttaaatttcacagacctcattaggttgtatggccctgagagtgggtatccttgagggagtacaagctgtttcaacttagcccttttctgcgctaattagaatttcaagcgtcacagagcctgggggctttcaagatagcactaaactaggtttacttaactccttggcaggaaatagtggcccccatgcatcacttctgtgaatccactgccagggagaagtggagaaacagatcatatatgtcacaggtctagagtggttggaattgacaaatataattagctagttggttaattagggtcatgtccatactttcatgatgaaagggaa

SEQ ID NO: 4062 - DNA, 3612 bp, Homo sapiens
gtgctggggccaagcaggcattaaactctacccatcaagacaaaatgcctagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtac

SEQ ID NO: 4063 - DNA, 5961 bp, Homo sapiens
ccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggccctgcttgatactcagaatcttttgcgtgcacaaatcacaaattttacattcaacctgggattttcagggaaattttaccatacaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggttctcccaagacaaacctgtgggcttttcactcacaccattttctacaaagaatatccagggggtcctaaagagctggataagagtatccaaggaggagaacttttcttcactgtcgtcctcaaccctatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcagaatccttgcgatgacaaacgccacagagacatttggtctaaagaaaaaacttgtgatcgcttaccaaaattcttggtaataggaccccagaaaactggtaccactgctttgtatttgttcctggttatgcatccttccatccttagtaactcccccagcccaaaaacctttgaggaggtacagttctttaatagaaataactaccacagggggattgattggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcagttgctaattattgatgggcaacaactaagaactgatcctgctacagtgatggatgaagtacagaagtttctaggagtcttgcctcattataattactcagaagctttaacgtttgattctcataaaggtttctggtgtcagttactggaagaaggtaaaacaaaatgccttggaaagagcaaaggaagaaaataccctccaatggattctgatagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaggcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaaattactatagtcttccatctccaccaacttaagaaaactggcttaggaaggttaaacatgagaataggcctcagcagttatatacagtgtcatgttttcatttggcaacaacatttattctaataaaaaaagaaaagaaaaactgatacatttatgctttaatggtaagatgtacatttgaactgctaagcaaagctgctaatggcctattttgtttaggtaaatcgagttgactgaacacttcatccttttaaatagatgtcaaaaacatactccgtgtttgtataaagacaggagaaaaaggaagagatcttaccaaaatttattcattcacaagtacatgtattacgctagctagagcagcaaacctgtgaaaggatttttgaccactcaatgtgtcttgaagacagcatcaaattctagaggacatgcatactttccacattatatactccaactggttaatatgctaatctgaaagtaacataaatacatatgagagaataatgagagataatctgatttaaaactagctttgtatagaattccctttttcattgtttaaaatatgaaacttcctcaggaagaaatgaaatggttatttcaatgtttatagctgtaatattcttgtcattcacattgaatgaaaattactggaaacatttttttctctgagttttttaaaataaaaaacctagatataattctgatagtagcatggtacctcatatgtacaacaataaactgataggaaaatgaagagtttggacctgg

SEQ ID NO: 4064 - DNA, 2001 bp, Homo sapiens
aaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggttctcccaagacaaacctgtgggcttttcactcacaccattttctacaaagaatatccagggggtcctaaagagctggataagagtatccaaggaggagaacttttcttcactgtcgtcctcaaccctatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcagaatccttgcgatgacaaacgccacagagacatttggtctaaagaaaaaacttgtgatcgcttaccaaaattcttggtaataggaccccagaaaactggtaccactgctttgtatttgttcctggttatgcatccttccatccttagtaactcccccagcccaaaaacctttgaggaggtatatggatttcttcccagtcccatctaatgtcactaccgactttttgtttgagaagagtgccaattacttccactcagaggaagcccct

SEQ ID NO: 4065 - DNA, 3351 bp, Homo sapiens
aaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgttaaaaaaaaaa

SEQ ID NO: 4066 - DNA, 6080 bp, Homo sapiens
ggttggctcgcgggtaggcggccccgccccccacatccgggggccggggccgggctgtgggcttgccgcgcgccggtgagtcaggccgggttttccctccgcctttggggcaggcgatcgagcgccgcggagcgcgtccctccctcgccaatccggctccggcgccggcgcccgcccgcgttttcccggcgcctgccgctccgccgctccgacccggcacgcagtcccggcccgagccgacgccttgcaggagggttcaaatccgcgcgggggagctgcgacgcgcaagggctgcggagccgcgggccggcgagcgcgtcgccaccatgaagcagctgcctgtaccctgttgaaacttcatggccacagccccaggccctgctggcattgccatgggcagcgtgggcagcctgttggaacggcaggacttctcccctgaagagctgcgggcggcacttgccgggtctcggggctcccgccagcctgatgggctcctccggaagggcttgggccagcgtgagttcctcagctacctgcacctccccaagaaggacagcaagagcaccaagaacaccaagcgggcccctcggaacgagcctgccgactatgccaccctctactaccgggaacattctcgcgcgggtgacttcagcaagacctcgctgccagaacggggtcgctttgacaagtgccgcattcgcccctcagtgttcaagcctacggcgggcaacgggaaaggcttcctatccatgcaaagtctggcgtcccacaaaggccagaagctgtggcgcagcaatggcagcctgcacacgctggcctgccacccgcccctgagccccgggccccgggccagccaggcccgggcacagctgctgcacgccctcagcctagatgagggcggccctgagcccgagcccagcctgtccgactcctccagtgggggtagttttggtcgcagtcctggtactggccctagccccttcagctcctcccttggccaccttaaccacctcgggggctccctggaccgggcctctcaaggacccaaggaggctgggccaccagctgtgctgagctgcctgcccgagccaccacccccctacgagttctcctgctcctctgccgaggaaatgggagccgtgctgcccgagacctgtgaggagctcaagaggggccttggcgatgaggacggctccaaccccttcacgcaggtgctggaggagcgccagcggctgtggctggctgagctgaagcgcctgtatgtggagcggctgcacgaggtgacccagaaggctgagcgcagcgagcgcaacctccagctgcagctgtttatggctcagcaggagcagcggcgcctgcgcaaggagctgcgggctcagcagggcctggctccggagcctcgggcccccggcaccctcccagaggctgaccccagtgcacgaccagaggaggaagcccgatgggaggtgtgccagaagacagcagagattagcctcttgaagcagcagctgcgtgaagcccaggcggaactggcccagaagctggcggagatcttcagtctgaagacacaacttcggggcagccgggcacaagcccaggctcaggacgcagagctggtccggctgcgcgaggctgtgcgcagcctgcaggagcaggcccctcgggaggaagccccaggcagctgtgagactgatgactgcaagagcaggggcctgctaggggaggcaggaggcagcgaggccagagacagtgctgagcagctgcgggctgagctgctgcaggagcgacttcggggccaggagcaggcgctgcgctttgagcaggagcggcggacttggcaggaggagaaggagcgcgtgctgcgctaccagcgggagatccagggagggtacatggacatgtaccgccgcaaccaggcactggagcaggaactgcgggcactgcgggagccccccacaccctggagtccccggctcgagtcctccaagatctgaggccagcagagcgagctgacagcagcaacactgtcagaaggtgccctgagacggccggctcagccttcccttgcactggttggggtggaacctgcagaggccagcccggggctggggaggcgcaaggagaggagggatccagtggggccgtgggctgggtagggtgccttggcaggagccaggacaaggccctcctggcagaggagcacctaggcagggcccagccctgcttcctggagtggatgtggcccagagaaggaggctgggggatcaccagccccaaggtcccgaagggcaggtcagagggagagaggctggagacctgggctggggccttcctccagggaaggaggctggggtgggaacactggcctcccccagaataaaaccatgttttctaccagaggctcagaatacgctgagcctgtgaccagaggatgatggatggtcgggattgaggctgttgacctgggcagtagctcctcccatggccagtggtcagtgggagggtgtgccctgcgcctgtctgcatggccactgggcatgtgtgttgggagcagaggagtcctactccttgcctcagccccacacggttccttagctgccgtgtgggctgaaattcctttctttagcaccagtggagttttcagaaggaacaacaccagggaatgccaaaaaaacaaagggcaagtcaaccaaggcattttgagaacatgaaatgtcttcttggtgggaaggctgggccccaggagtatccacaggctcaggccatgcccctccccgcacccacctcctgtctccctccctccctccataggagtggggggcccctagaagtgctctgcctcattccctgttcgtaggaaggtgcaggagaggaggtgggcaagcttatgggtttcttggtaaagagcctttaccacagcaaggaatgggaacatttccccatcagcaacggggctctagggcattattaagtaggggtgaaatatgattgatttgcattctggaaagctctcccaggaggaagcattccccaccccaccttgcctctgtcctgcgctgggctccaggacggtcagtcctcccggatccctgctctcagctaaggctggtccctaaaacccacacctgcctttggtctctcagaggcctggcttgccctctgggcctttgctcccccgctgggtgcccggcctggaacacaggttctgtctggctgtgtgagtggcgtctctcccttcctttgagggaagctcagctttcttacgcgctcatcgttggacgggctgccatgcattgcgtgcttactgggcgccaggtgctgtgctgggcccttgtgagtgtgggggcacaggctgaattagatgagctcctgccgcagggggccctgcacactgatgtcagctcaccagtctcttccctgacagggcagctcagggaacttctgagaagttatctgcagagagccccacctcactccctttggctaccctggccgtgcctggcagcccctcaggccccacaggtgggtcctggttgtgaagtggagttagtgcacatggatgtcaggggacgggtgtgaggcatgagctgggggggccccctttttcagggcagagaatgaggcgtgtgcactgtctgctgtggggatggtgtgtttatggccatgtaagtggcaggtgtgtgtaaagatgtgcttgtgggtggtgggtgtgtctgagggggtgtgtttgggagcctggcctccaaaagccagtgtctgggttggagacagtgcaggccccttcttggccccaccctctaccccattccttcctgtcagccccagtctgtcttggcactggccaggcttgggtggagcctgtgtcccagacagatcccctaggcctatctgagacccatacaggcccacacctgagctcctgtctgcctgaggagggaaagggggagtggccaggtcaggcaggccagtcgtctacacacccccttggtacccattcccatttcacaaactcctccaaaccccaaaccccaaacggaaatctctgggacaatggctcctccagagggcccctcagagccaggtgctggccagatgccttgatcacagcctccatggccaggggcctgtcaagccaggggcccacacacctggtgccagggtccaccttggtataccagctcggcagaacagttccccacccagcgattagggagctgggctggccagtacagccagtggggagtgggtgggaggcaccaaaacttggcagctgtgccagaaaccaaagccaggcccagatgtagggggagggcacgagagctgaacctgagcctggggcgtctcggagctggatccccgtcagctcatccaggctggacaaaccagttcctgggtcccccagccggctgggtggctctggggccaaccgaccacaggtgtcactgatcacaggtgtcaccgtagtggctaccacctcagggcagcccctccctccagctggcggggcctcagcttcccagctgccctggcttagccttccctgcagcccctccccaacaggcttggtccgggcagcctgctctgcggaaggtggcagcctcctggtgctgggctccctgcctctggggcctccagtccttcactcagtgtcatcccttccagcagctccctgggcctcttggtccatcccttcaggcttctgacacactagtggcctcgagtcactgatagtggtgcctcctccttaccttggcaagcccttgtagccctctgagccctcatcctgcaggcagagcccctcagtgctctgagaaacctgccctgaactcaccgcctcccctgcctgggcactccctcctccctgcgcccacagcccccatgccaatctccgtcagctctttctgtgctgctgtaattgttggtttgcctgtctcctttgagctgtgggcattgccggggtagggtggtgtcttcaccacagctccagaaggcactggtgggatgtggagtcaggagcaaccagagaccccccaatactagaatgggtttgagcttggggtggggtggatggggaagacttactctgaatgttcgttcaccatccgtgggcaccaggtctgtgccaagcacagggactccaggggcagctgccattcgttccagtgatgtatttggggccttctcaggtgaggaagccaaggtggccaaggccctcggtcccctgccctgatagggcttacctgtgggtgggggagggagaccacacatgtcagaggtagtgaaggccgctccaaatagtgactggggccaggcaggcggaaaagagaacagaagagaatccagaagtgttcagacagaactagggacaacagaggggcctccatggtggcatgggtcagcagagcatggagcaggcagaggaagcctatctgtggggctgggtacatttctctgagactcacggaatgtaagtgttgaggtttctgcaaagagggcgcaggccctgcagtgacggttcagatattgataacccatcccccttggcaggtgggggcttaggcatccatattggattcagaaaagaaaaagaatgatgcttcttgcaacaaaaacaaaagtgattatgtcacgagaggagaggctggagggccatgggagttcccagctggctcactcatccgtccaggaggtgggtctcatggtttcattttgctttgggcttacttagagttttggcaaatgcagagttatgtaacgaacccaacaatgaagatacagttctgtcacccccccagcattctcctgtggccctctagtccaccccccgccccaccccagcccctggcaaccactgatctgctttcacaataaccgtatggggttttttctctttccttttttgtgagcggtatttaattcctttgctctaatatgtaatattagaacatattacaaagtagcaagaaaaatacgacattggtgtaaaaataatctacacctcatggaaagaatgaagagccagaaatagattctattctgtagaaaatcttacacaataaaggacttcaaaataagggtaa

SEQ ID NO: 4067 - DNA, 3711 bp, Homo sapiens
agccttgacgcgctgcgcctgcgcaatgtctctttgcggggcgcaccggcaggctcccagccccgcttcgtcgcagcggcttgggccctccggccctccgtagccgctcgactgtcgcgctgcaccagcttcctcctcggcgttcccacgcctatttgggcggattcttggcgccggaggaagaggcagggtcaccctctctccacgtcagagacctgactgtggagatggcggctcagaagataaacgaggggctggaacacctcgccaaagcagagaaatacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaattttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactatataaat

SEQ ID NO: 4068 - DNA, 1245 bp, Homo sapiens
atttgggcggattcttggcgccggaggaagaggcagggtcaccctctctccacgtcagagacctgactgtggagatggcggctcagaagataaacgaggggctggaacacctcgccaaagcagagaaatactgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattat

SEQ ID NO: 4069 - DNA, 3109 bp, Homo sapiens
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtacggcaccttccggtaccttttccaaagatgccttcctccactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcc

SEQ ID NO: 4070 - DNA, 2045 bp, Homo sapiens
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccactgcaggttcctttggcaccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtga

SEQ ID NO: 4071 - DNA, 4768 bp, Homo sapiens
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcctccacggcctgttttctttctgtgttggggacggtgggcaggtgtggggcttacagaggaatccacaacacagccttaaagaaacggtttccctactggggccaccatttccctgggcctttctgtggattccagcaggcagtgccccctccccgcaggcttggctggcagagttttccaccccgcggccaggctgcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcctctgattcagaggatccagcagttctcccatctccgcttggtgtctccagccctggggccacacttccccctcggtccagcctcctgtccacctatgtttatttcagagcagtgccgggggtccggtcctggttgctaactgctgccactgctccacctgcaggtgctcccagcactggcttctgccaccacacctgttctttcccagctgcgaggtttagacctgggtccttcccttgagtccccaaagctaagctaagaccaagtggaacaaacttggccttggggacagcaggagattacaacacagaaaaggagggggaggcacaacgggacactgcataggactcacagtgtcccgagcccacacaccagcccctcctggcctcctctctctgctcccacccccagcaccctgctgacccggaagtgccttccgacaggccctgcatcctcctgcagctggcccatctctaccctcacattcttccttacgcacagaaccccactgcctgggacccaaagtgcccagataaaataaaacacctctctggggcttcttgtggataggagtggccaggggacacagctctgggcagtgagatgtaagcaggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagcctccggccttggcctcccgaagtgctgagattacaggcatgagccaccgcaccacctgcctgtcttactgtgtgagaaaaaaaataaacggtgatgtgattaaaacactagaa

SEQ ID NO: 4072 - DNA, 4792 bp, Homo sapiens
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccactgcaggttcctttggcaactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcctccacggcctgttttctttctgtgttggggacggtgggcaggtgtggggcttacagaggaatccacaacacagccttaaagaaacggtttccctactggggccaccatttccctgggcctttctgtggattccagcaggcagtgccccctccccgcaggcttggctggcagagttttccaccccgcggccaggctgcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcctctgattcagaggatccagcagttctcccatctccgcttggtgtctccagccctggggccacacttccccctcggtccagcctcctgtccacctatgtttatttcagagcagtgccgggggtccggtcctggttgctaactgctgccactgctccacctgcaggtgctcccagcactggcttctgccaccacacctgttctttcccagctgcgaggtttagacctgggtccttcccttgagtccccaaagctaagctaagaccaagtggaacaaacttggccttggggacagcaggagattacaacacagaaaaggagggggaggcacaacgggacactgcataggactcacagtgtcccgagcccacacaccagcccctcctggcctcctctctctgctcccacccccagcaccctgctgacccggaagtgccttccgacaggccctgcatcctcctgcagctggcccatctctaccctcacattcttccttacgcacagaaccccactgcctgggacccaaagtgcccagataaaataaaacacctctctggggcttcttgtggataggagtggccaggggacacagctctgggcagtgagatgtaagcaggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagcctccggccttggcctcccgaagtgctgagattacaggcatgagccaccgcaccacctgcctgtcttactgtgtgagaaaaaaaataaacggtgatgtgattaaaacactagaa

SEQ ID NO: 4073 - DNA, 1278 bp, Homo sapiens
cttcctcccgccccttctttggtccctacggacctggggggcggtggcggtcaatgccgggtcaaggtccgcgggcctcgcagatcgtagcccgggcgcacgcgatcagatgatcctgttgtggacggctaagttgtaggcgggatggctgagaaagcggcgctaggacccccgggcagaggctcggggaagggagtcaggggggaaatgccttacaaggtcgccttgcggtcaccatcattgcccgccgcccaaaatagcccccggcgccagctggcctgccctatggccgagagatggctgctgcctccgagcccgtggattcgggtgcactctggggactcgagcgcccggagccccctcccacccgcttccatcgggtgcacggtgccaacatccgcgtggacccctctgggacgcgggccacacgcgtggagagcttcgcccacggcgtgtgcttcagccgcgagccgctggccccgggccaggtcttcctggtcgagatcgaggagaaagagctgggctggtgcggacatctgcgtctcggtctgaccgcgctggaccccgccagtctggcccccgttcccgagttttctctgcccgatctggtcaacctgggccacacctgggtcttcgccatcacgcgccaccacaaccgcgtgccccgggagggccgcccggaggcggaggcagcggcccccagccgacctccaaccctcctcgtggaaccatatctgcgcattgagcagtttcgcattccccgggaccgcctggtgggccgcagccggccagggctctacagccatctcttggaccagctctatgagctgaacgtgctgcctccgaccgcgcgccgtagccgcctgggtgtcctcttttgcccgcgccccgatggcacggccgacatgcacatcatcatcaacggcgaggacatgggcccgagcgcccggggactgccagctgcgcagcccctctacgcggtggtggacgtgtttgcttccacaaagagcgtgcgccttgtccagctcgagtatggcttgccatccctgcagactctgtgccgcctagtgatacaaaggagcatggtgcaccggctggccattgatgggctccacctgcccaaagaacttaaggatttctgcaagtatgagtgaagacccacagtgcaccagagcacagctgcatcctggagccccagacctgtggctggctggtccgaagttggccacattgctgccagccaagaccagaaataaacagccgatgctgacatcttga

SEQ ID NO: 4074 - DNA, 800 bp, Homo sapiens
agctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaagcaggaactgggttttcacacatcctcccacagccaagagtggaatcggaagttacagcacaaaaactgtcctcgctgctgtttcgggagtttgtcaccacctggagaggcccttctctgtcgccattgggattggccttaccaccctaaggccccaggttgctctgctgagcctggaggaggacccttccaaagcattccaactcttctgtgtggccctaaacgaggctgctttgcttcctcagaactttaaacaacctctgcattgcaattttttgactctttccatttgggagtcctctttctgttagacctgggaccaattcgactttgaactgtgtccagagataatttttatgatactgtatggaattgctccctcaatttttatcctttccagtactcagcatggtaccaagactaagctgatgagtcccaactgctctcctcacctcccatatgctactcatgagactccttcgtacctatcatcccacgctctccctcccatgttttaacatgtctggaattccccaatgggtgcatctctcagagattctcattaaagactggcattaacagccccttcagaagccttgaa

SEQ ID NO: 4075 - DNA, 817 bp, Homo sapiens
acgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacatcaaagcccacacccagccggttacaaaagctccaggaactcctctttcatagatcgtgactttgtgttattttccgtgttgtttgaaagtgccgaacagtttagaccagctcaccaatggctaatgtggtccattttattttctaatattgg

SEQ ID NO: 4076 - DNA, 742 bp, Homo sapiens
aaagctggaaccctgcccctttggagggggaggcggcggcggcggcggcggctgcgcgggcctcgggtgcgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaagcaggaactgggttttcacacatcctcccacagccaagagtggaatcggaagttacagcacaaaaactgtcctcgctgctgtttcgggagtttgtcaccacctggagaggcccttctctgtcgccattgggattggccttaccaccctaaggccccaggttgctctgctgagcctggaggaggacccttccaaagcattccaactcttctgtgtggccctaaacgaggctgctttgcttcctcagaactttaa

SEQ ID NO: 4077 - DNA, 2354 bp, Homo sapiens
aaagctggaaccctgcccctttggagggggaggcggcggcggcggcggcggctgcgcgggcctcgggtgcgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacatcaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgctgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttccctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcatctcatcacttgcacttttgttttaatgtatggattcagattagactgagaaaaatggatggtattttcttaaaattgtgccaccttagagcccccccccttttttttttcttccttcactggataaataaaatatgtgaacaagtggaacctgaa

SEQ ID NO: 4078 - DNA, 637 bp, Homo sapiens
ctcctgcactaggctctcagccagggatgatgcgctgctgccgccgccgctgctgctgccggcaaccaccccatgccctgaggccgttgctgttgctgcccctcgtccttttacctcccctggcagcagctgcagcgggcccaaaccgatgtgacaccatataccagggcttcgccgagtgtctcatccgcttgggggacagcatgggccgcggaggcgagctggagaccatctgcaggtcttggaatgacttccatgcctgtgcctctcaggtcctgtcaggctgtccggaggaggcagctgcagtgtgggaatcactacagcaagaagctcgccaggccccccgtccgaataacttgcacactctgtgcggtgccccggtgcatgttcgggagcgcggcacaggctccgaaaccaaccaggagacgctgcgggctacagcgcctgcactccccatggcccctgcgcccccactgctggcggctgctctggctctggcctacctcctgaggcctctggcctagcttgttgggttgggtagcagcgcccgtacctccagccctgctctggcggtggttgtccaggctctgcagagcgcagcagggcttttcattaaaggtatttatatttgtagtaa

SEQ ID NO: 4079 - DNA, 5454 bp, Homo sapiens
atttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctat

SEQ ID NO: 4080 - DNA, 3750 bp, Homo sapiens
gtttcgggttccctagaaaaatctggacgtgtaaaaagaactcttaacggccgatgcagctcttccaaagctaagggaccattcccctccaaaatcctacaaggtgggtccatgacatctgctagagaaaaagagggacatgttggagcgataggattcccatgggcactgacatactggcctctggggataggaagattaatgcttagtacaagaaagaaggaaaagaaggccttggcgaggactgttttatctcagcatttctcagaagctccttcagtggagacttcgcctgggaccttcgccccaccttcttctaatggcacttcctccctgtggggctccacgcgggacattacgtcggtgatgcgtagggcatcgggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttg

SEQ ID NO: 4081 - DNA, 5748 bp, Homo sapiens
atttaagcgattttttttccctccttcatctccgggcctcggataagatgacggcttgggtgatgcacgaaataacgcacgtgattgattagacctggcttggcttggctagggaacgatccaggcgcgctggagaccccgcgtgaagatgaaatgacggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatggagccaacacaaagaaaaacgcagatgatataacgagtaatgaccgtggtgaagacgaagatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttct

SEQ ID NO: 4082 - DNA, 5870 bp, Homo sapiens
aaccgtctctctcccttctctgtctcttagcacagagctcttattcagccactagcttggcccttcctgcttcaattgtaatgcttgttctgcccgtccacagactattggcggcagaaacaacgaatttcctccaaactaggcggtgttggtggctcttgcattcctctggatgaggaaatctagttggggggttccagaaggggaaggctcctgggctttcaatacatcctcctgaatcatacctcgtttcgggttccctagaaaaatctggacgtgtaaaaagaactcttaacggccgatgcagctcttccaaagctaaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgataggacatcaccatttcaaggccccgggtgtttccaacgtcatggaagcagctgacacttctgaaactcagccaaggacacttgatattttttaattacaatggaagtttaaacatttctttctgtgccacacaatggatggctctccttaagtgaagaaagagtcaatgagattttgcccagcacatggagctgtaatccagagagaaggaaacgtagaaatttattattaaaagaatggactgtgcagcgaaatctgtacggttctgtgcaaagaggtgttttgccagcctgaactatatttaagagactttgtaaaaaagaaaaatgtatatagctgtgagtttaaacaaaaaccacaaacagacaaacaagaaaaaaagcttttattggtgttttcactttgaaagagcttttagcaaggttgtgcttttcattgtgctctgtacgtatataaatatatatatatatacacacacacacacacattagtcatatcacctctgtttcctccccaacaaaagaggcttttcttcttaattacttgtggtaaacaaagacatgggattttcttacatgagattctcatttgtaggaggatgtgatgtcccacagaagacccagacggtctgtgtggcctatttcccccgtcaggttgcacaggtgcatgcaagagcattcttaggagaccactgttttgaaaaacttttgacttgtacgtgttagccttcatgaaattgcagtacagagatgggtccccaaagtggagtgtatttacagcttgttaaattagagacatgcacacacaaagaatcagtagggagaaacaaaaatacaagtcccgttctgtagctctggccctttgaatatgtttaggaagagttgcttcccatttcagggccctgccaaaaaaagaagaaagcttgcctttggtggggctatgccccttggagtaaatacggctctgtgttccctagcagctgcgggagggtttggccgatgaagtacctgctcagcttagctaatcagattgaaggaagacatgtgtctttcctttttgtttaagcactcggtcccttatttatcagtaagcaggtttttaaaaatcttttatatcatttatgggatcaaacatatgattgtctgaaaacatcactttttgtggatttgtgtatccggtcaccaaacggtgaatattatagaagaatgggggaagaaaggatagaatattaaaactgctttgcatgggttttctgggaaattaggataacttcactgagaagacattgaatggaaattattcacccattttaaattggtgacctagggatcagagatttgtctttccaacagcttgtcattttttcatttctcttctcatttttcaggaaagttttgagtgttataaggtggaaggaaacatagtagcaatggatacttttttgaaaaattattgcattaccaagaaacagtagccaaagatatttgaagatcatgttcctcggctccattgtgggttattctagaaatccagtcttaaatctctccgctaaagtggacattccccataaaaattgtccagctgcctggctcttttgcaataacaacctttgattactgaatccctacactcaaactatagtgatatatcagtgtttgagagtgacctctagaaaaaagaaaagtgtttttagaaatgcgtacaagtcacccccaaatcctattgcttatcttgggttaaatttgagagtgattctctgtatataaatatgtgaaatattattatctcaacttagcacacgtgaagcaacatttctttcctacagagaggtgtcatggtaagatttcattccgaattcattgtttcatagagctatgatcaggccatttctgcaagcaatgtatgaccccacctgagcaaccacaaataggctctctgtgaaactacaaaggaagttatgtgtggcatccatgttggtttcgtctgtctgtaatgtgaattccagtatttgtttagtatttccagttgtctcctgctagcaatatgtacagtaacgcgtcaggcttgtgacatttgaataaggaaaaacagagttcctgttaagtgaataactttagcttttacaggggattatgatcaaaagtgattttagtacatcttaaatgatatcttatttctacatggaaagaagttatagaatcttcatagagttctatgagaaaaaatatacttgctatctataaaaaagagaaaaaagaaaaaaaatgagaaaaaagtaagaaaaaaaaaaatcctgtcctaggcttttactcttgatcttcaaaggcacgcagggtttaatggttccttgggttattattttgcagttttgttttttattttgccttaagtaatgatagaagatatatatggccggacacatatgtataaacttttcagcagcatttttaataataaaatatcacagtattttctaatgctttgtgcaaataa

SEQ ID NO: 4083 - DNA, 3251 bp, Homo sapiens
agaactgatggagaagatccgccaagcgcgcagccggcggcggaggagacagtgcggggtgggcgaggggcttcgagaccacgcagagagagagtgaacttcagtcctgacccctccccaaggccgcggctggggcgcccacagcccgcgctggcacccgcgtggcctgacctgcggaagcgcgagcggggatgaggctgccttggagttttcataagaaattgtccctggaggtgttggatgatcacagcttccttggagcattgcagttgctggaatccagtttcaggattaagggagggctgcctccttgcaatgggctgccaagaaaacggctgtgcttgttcttaacctcaggctctgtctgtgatcagtctgagagtctctcccaggtctactgctccctggaaagccctatctctctgcaggctcgcctctgggctttgtctccttggagccacatcactgggacagctgtggatgtggatgcagatttgaaccatgtcacggccccagggactgctatggcttcctttgttgttcaccccggtctgcgtcatgttaaactccaatgtcctcctgtggttaactgctcttgccatcaagttcaccctcattgacagccaagcacagtatccagttgtcaacacaaattatggcaaaatccggggcctaagaacaccgttacccaatgagatcttgggtccagtggagcagtacttaggggtcccctatgcctcaccccccactggagagaggcggtttcagcccccagaacccccgtcctcctggactggcatccgaaatactactcagtttgctgctgtgtgcccccagcacctggatgagagatccttactgcatgacatgctgcccatctggtttaccgccaatttggatactttgatgacctatgttcaagatcaaaatgaagactgcctttacttaaacatctacgtgcccacggaagatgatattcatgatcagaacagtaagaagcccgtcatggtctatatccatgggggatcttacatggagggcaccggcaacatgattgacggcagcattttggcaagctacggaaacgtcatcgtgatcaccattaactaccgtctgggaatactagggtttttaagtaccggtgaccaggcagcaaaaggcaactatgggctcctggatcagattcaagcactgcggtggattgaggagaatgtgggagcctttggcggggaccccaagagagtgaccatctttggctcgggggctggggcctcctgtgtcagcctgttgaccctgtcccactactcagaaggtctcttccagaaggccatcattcagagcggcaccgccctgtccagctgggcagtgaactaccagccggccaagtacactcggatattggcagacaaggtcggctgcaacatgctggacaccacggacatggtagaatgcctgcggaacaagaactacaaggagctcatccagcagaccatcaccccggccacctaccacatagccttcgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccaccagtgggtggcccccgccgtggccaccgccgacctgcacgcgcagtacggctcccccacctacttctatgccttctatcatcactgccaaagcgaaatgaagcccagctgggcagattcggcccatggtgatgaggtcccctatgtcttcggcatccccatgatcggtcccaccgagctcttcagttgtaacttttccaagaacgacgtcatgctcagcgccgtggtcatgacctactggacgaacttcgccaaaactggtgatccaaatcaaccagttcctcaggataccaagttcattcacacaaaacccaaccgctttgaagaagtggcctggtccaagtataatcccaaagaccagctctatctgcatattggcttgaaacccagagtgagagatcactaccgggcaacgaaagtggctttctggttggaactcgttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcctgaggacacaactgtcctcattgaaaccaaacgagattattccaccgaattaagtgtcaccattgccgtcggggcgtcgctcctcttcctcaacatcttagcttttgcggcgctgtactacaaaaaggacaagaggcgccatgagactcacaggcgccccagtccccagagaaacaccacaaatgatatcgctcacatccagaacgaagagatcatgtctctgcagatgaagcagctggaacacgatcacgagtgtgagtcgctgcaggcacacgacacactgaggctcacctgcccgccagactacaccctcacgctgcgccggtcgccagatgacatcccacttatgacgccaaacaccatcaccatgattccaaacacactgacggggatgcagcctttgcacacttttaacaccttcagtggaggacaaaacagtacaaatttaccccacggacattccaccactagagtatagctttgccctatttcccttcctatccctctgccctacccgctcagcaacatagaagagggaaggaaagagagaaggaaagagagagagaaagaaagtctccagaccaggaatgtttttgtcccactgacttaagacaaaaatgcaaaaaggcagtcatcccatcccggcagacccttatcgttggtgttttccagtattacaagatcaacttctgaccctgtgaaatgtgagaagtacacatttctgttaaaataactgctttaagatctctaccactccaatcgatgtttagtgtgata

SEQ ID NO: 4084 - DNA, 3124 bp, Homo sapiens
aggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggat

SEQ ID NO: 4085 - DNA, 4172 bp, Homo sapiens
tgttttttgagacagagtcttgttctgtggcccaggctggagtgcaatggtgtaatctcagctcgccacaacctccacctcctgagttcaagcgattctcctgcctcagcctcctaagtagctgggattacaggcatgcgccaccacgcccggctaatttttgtatttttagtagagatggggtttcaccatgttggtcaggctggttttgaactcctgaccttgtgatctgctggtcttggcctcccaaagtgctggtgtgtctggaattggttacttctggtgcgttcttcgtctcgctgacttcaagaatgaagccacggaccctcgcgagttggacaggttggattatttgaaaacagcctgggttgtgagaggaaaatgagcaggccagaggaatttggagctgccagcatcttggagggcccagatacaatcagcagaggaagaaaaccacaggatgaaacagtcccaatgaccagcaccagtgaagacccaagacagcacaaaaggccagctagcagagaaacatgattgttcaccgtccatctctgggacaacctagatgcctgggcagatttctgaagtggagcaagagaaatcttctcttcttcacctgcttcagggaggcatcaaagtgccaaaaaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 4086 - DNA, 2254 bp, Homo sapiens
ccctccccaacccagcactaaggagcaccctgctctggtctccgccaccacccagcgcctcctggacccatccccccaaacccttgaacgtcctcaggacccccaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtg

SEQ ID NO: 4087 - DNA, 980 bp, Homo sapiens
attgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcgg

SEQ ID NO: 4088 - DNA, 973 bp, Homo sapiens
ggaagaaaaccacaggatgaaacagtcccaatgaccagcaccagtgaagacccaagacagcacaaaaggccagctagcagagaaacatgattgttcaccgtccatctctgggacaacctagatgcctgggcagatttctgaagtggagcaagagaaatcttctcttcttcacctgcttcagggaggcatcaaagtgccaaaaaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtg

SEQ ID NO: 4089 - DNA, 798 bp, Homo sapiens
cctgaccagtgggtcactctcatggcagatgcctgggcagatttctgaagtggagcaagagaaatcttctcttcttcacctgcttcagggaggcatcaaagtgccaaaaaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaaggg

SEQ ID NO: 4090 - DNA, 3291 bp, Homo sapiens
agagatggggtttcaccatgttggtcaggctggttttgaactcctgaccttgtgatctgctggtcttggcctcccaaagtgctggtgtgtctggaattggttacttctggtgcgttcttcgtctcgctgacttcaagaatgaagccacggaccctcgcgatgcctgggcagatttctgaagtggagcaagagaaatcttctcttcttcacctgcttcagggaggcatcaaagtgccaaaaaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 4091 - DNA, 1486 bp, Homo sapiens
gggagcggccgtggagcccaatcgttcgctccccttcccgggtccgcgcgcggcgccgcctccgccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaaggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 4092 - DNA, 2452 bp, Homo sapiens
acagatggtgtgggagcgcgttccccggtaggagggggcgcgagcgagcaagcaggcaggcagctgccaggagctcttccctgctcgctcacgcctgctctcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgaga

SEQ ID NO: 4093 - DNA, 613 bp, Homo sapiens
gctattttctctgtcgtcagccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactag

SEQ ID NO: 4094 - DNA, 643 bp, Homo sapiens
gatccagacacacgcgaggcgctgtcctttcagcaccacaagctcgggctgaggagggaggactcctggccgtcctcctcctcttcaaattggcttgaatctgctctgaccccccacgagtgcagcacaccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcac

SEQ ID NO: 4095 - DNA, 568 bp, Homo sapiens
aaaaaaaaaaaaaaatggcccttcgctattgaggaaatggaggcattccatggctgaataacaggatcaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgt

SEQ ID NO: 4096 - DNA, 1301 bp, Homo sapiens
ggggcatcatggagggggagccctcccagcctcccaacagcagttggcccctaagtcagaatgggactaacactgaggccaccccggctacaaacctcaccttctcctcctactatcagcacacctcccctgtggcggccatgttcattgtggcctatgcgctcatcttcctgctctgcatggtgggcaacaccctggtctgtttcatcgtgctcaagaaccggcacatgcatactgtcaccaacatgttcatcctcaacctggctgtcagtgacctgctggtgggcatcttctgcatgcccaccacccttgtggacaacctcatcactgggtggcccttcgacaatgccacatgcaagatgagcggcttggtgcagggcatgtctgtgtcggcttccgttttcacactggtggccattgctgtggaaaggttccgctgcatcgtgcaccctttccgcgagaagctgaccctgcggaaggcgctcgtcaccatcgccgtcatctgggccctggcgctgctcatcatgtgtccctcggccgtcacgctgaccgtcacccgtgaggagcaccacttcatggtggacgcccgcaaccgctcctacccgctctactcctgctgggaggcctggcccgagaagggcatgcgcagggtctacaccactgtgctcttctcgcacatctacctggcgccgctggcgctcatcgtggtcatgtacgcccgcatcgcgcgcaagctctgccaggccccgggcccggcccccgggggcgaggaggctgcggacccgcgagcatcgcggcgcagagcgcgcgtggtgcacatgctggtcatggtggcgctgttcttcacgctgtcctggctgccgctctgggcgctgctgctgctcatcgactacgggcagctcagcgcgccgcagctgcacctggtcaccgtctacgccttccccttcgcgcactggctggccttcttcaacagcagcgccaaccccatcatctacggctacttcaacgagaacttccgccgcggcttccaggccgccttccgcgcccgcctctgcccgcgcccgtcggggagccacaaggaggcctactccgagcggcccggcgggcttctgcacaggcgggtcttcgtggtggtgcggcccagcgactccgggctgccctctgagtcgggccctagcagtggggcccccaggcccggccgcctcccgctgcggaatgggcgggtggctcaccacggcttgcccagggaagggcctggctgctcccacctgcccctcaccattccagcctgggatatctga

SEQ ID NO: 4097 - DNA, 1287 bp, Homo sapiens
ggggagccctcccagcctcccaacagcagttggcccctaagtcagaatgggactaacactgaggccaccccggctacaaacctcaccttctcctcctactatcagcacacctcccctgtggcggccatgttcattgtggcctatgcgctcatcttcctgctctgcatggtgggcaacaccctggtctgtttcatcgtgctcaagaaccggcacatgcatactgtcaccaacatgttcatcctcaacctggctgtcagtgacctgctggtgggcatcttctgcatgcccaccacccttgtggacaacctcatcactgggtggcccttcgacaatgccacatgcaagatgagcggcttggtgcagggcatgtctgtgtcggcttccgttttcacactggtggccattgctgtggaaaggttccgctgcatcgtgcaccctttccgcgagaagctgaccctgcggaaggcgctcgtcaccatcgccgtcatctgggccctggcgctgctcatcatgtgtccctcggccgtcacgctgaccgtcacccgtgaggagcaccacttcatggtggacgcccgcaaccgctcctacccgctctactcctgctgggaggcctggcccgagaagggcatgcgcagggtctacaccactgtgctcttctcgcacatctacctggcgccgctggcgctcatcgtggtcatgtacgcccgcatcgcgcgcaagctctgccaggccccgggcccggcccccgggggcgaggaggctgcggacccgcgagcatcgcggcgcagagcgcgcgtggtgcacatgctggtcatggtggcgctgttcttcacgctgtcctggctgccgctctgggcgctgctgctgctcatcgactacgggcagctcagcgcgccgcagctgcacctggtcaccgtctacgccttccccttcgcgcactggctggccttcttcaacagcagcgccaaccccatcatctacggctacttcaacgagaacttccgccgcggcttccaggccgccttccgcgcccgcctctgcccgcgcccgtcggggagccacaaggaggcctactccgagcggcccggcgggcttctgcacaggcgggtcttcgtggtggtgcggcccagcgactccgggctgccctctgagtcgggccctagcagtggggcccccaggcccggccgcctcccgctgcggaatgggcgggtggctcaccacggcttgcccagggaagggcctggctgctcccacctgcccctcaccattccagcctgggatatctga

SEQ ID NO: 4098 - DNA, 1922 bp, Homo sapiens
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaa

SEQ ID NO: 4099 - DNA, 1234 bp, Homo sapiens
atgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaa

SEQ ID NO: 4100 - DNA, 1559 bp, Homo sapiens
tgcctctgcccacctcttctcttctgcttccatattacaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtt

SEQ ID NO: 4101 - DNA, 1866 bp, Homo sapiens
cctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtctcctcagttgcgaaattaggatgttaattatagcttttgacatacaagaaacatcaaaaagattgaatgtcttaataagagtgaagcatgtagatcagtgactgctatgttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtt

SEQ ID NO: 4102 - DNA, 1352 bp, Homo sapiens
ggcagggacggatccacatctcttcccaggagggtggccagcagctgctctctgcgggaggagggaactgatctgctgaagtctcaccaggaagaggcgggaggaggcccccacacaccccaccaggctccctctggccccatgtccttgacctggcaaagtggccgcagtctctgccagagaacctggagtggctgtgccctaacagacggccggatctcaaagtctctggttgtttttctttcctagaatccagcccaaggaggcccccaaccagatacccaactccaaggcacctcccacctgcccagggcgcaaatcgtcaacggtcccagctacaatgcaggccgctgggcacccagagccccttgacagcaggggctccttctccctccccacgatgggtgccaacgtctctcaggacaatggcactggccacaatgccaccttctccgagccactgccgttcctctatgtgctcctgcccgccgtgtactccgggatctgtgctgtggggctgactggcaacacggccgtcatccttgtaatcctaagggcgcccaagatgaagacggtgaccaacgtgttcatcctgaacctggccgtcgccgacgggctcttcacgctggtactgcccgtcaacatcgcggagcacctgctgcagtactggcccttcggggagctgctctgcaagctggtgctggccgtcgaccactacaacatcttctccagcatctacttcctagccgtgatgagcgtggaccgatacctggtggtgctggccaccgtgaggtcccgccacatgccctggcgcacctaccggggggcgaaggtcgccagcctgtgtgtctggctgggcgtcacggtcctggttctgcccttcttctctttcgctggcgtctacagcaacgagctgcaggtcccaagctgtgggctgagcttcccgtggcccgagcaggtctggttcaaggccagccgtgtctacacgttggtcctgggcttcgtgctgcccgtgtgcaccatctgtgtgctctacacagacctcctgcgcaggctgcgggccgtgcggctccgctctggagccaaggctctaggcaaggccaggcggaaggtgaccgtcctggtcctcgtcgtgctggccgtgtgcctcctctgctggacgcccttccacctggcctctgtcgtggccctgaccacggacctgccccagaccccactggtcatcagtatgtcctacgtcatcaccagcctcagctacgccaactcgtgcctgaaccccttcctctacgcctttctagatgacaacttccggaagaacttccgcagcatattgcggtgctgaagggcctggg

SEQ ID NO: 4103 - DNA, 3547 bp, Homo sapiens
acgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataa

SEQ ID NO: 4104 - DNA, 7481 bp, Homo sapiens
acgcggcgctcgcgctccctccttaaatgagcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcgaagcgccgggcagctcgggaacatggccctggagcggctctgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccagatccagactttacttacctaggaggtattttaaatcccattccagattgtcagttcgagctctcgggagctgatggaatagtgcgctctagtcaggtagaacaagaggagaaaacaaaaccaggccaagccgttgattgcatctggaccattaaagccactccaaaagctaagatttatttgaggttcctagattatcaaatggagcactcaaatgaatgcaagagaaacttcgttgcagtctatgatggaagcagttctattgaaaacctgaaggccaagttttgcagcactgtggccaatgatgtaatgcttaaaacaggaattggagtgattcgaatgtgggcagatgaaggtagtcggcttagcaggtttcgaatgctctttacttcctttgtggagcctccctgcacaagcagcactttcttttgccatagcaacatgtgcatcaataattctttagtctgtaatggtgtccaaaattgtgcatacccttgggatgaaaatcattgtaaagaaaagaaaaaagcaggagtatttgaacaaatcactaagactcatggaacaattattggcattacttcagggattgtcttggtccttctcattatttctattttagtacaagtgaaacagcctcgaaaaaaggtcatggcttgcaaaaccgcttttaataaaaccgggttccaagaagtgtttgatcctcctcattatgaactgttttcactaagggacaaagagatttctgcagacctggcagacttgtcggaagaattggacaactaccagaagatgcggcgctcctccaccgcctcccgctgcatccacgaccaccactgtgggtcgcaggcctccagcgtcaaacaaagcaggaccaacctcagttccatggaacttcctttccgaaatgactttgcacaaccacagccaatgaaaacatttaatagcaccttcaagaaaagtagttacactttcaaacagggacatgagtgccctgagcaggccctggaagaccgagtaatggaggagattccctgtgaaatttatgtcagggggcgagaagattctgcacaagcatccatatccattgacttctaatcttctgctaatggtgatgtgaattcttagggtgtgtacgtacgcagcctccagggcaccatactgtttccagcagccaacccttttctcccatcacaactacgaagaccttgatttaccgttaacctattgtatggtgatgtttttattctctcaggcagtctatatatgttaaaccaatcaaggaacttactctattcagtggaaacaataatcatctctattgcttggtgtcatttataggaagcactgccagttaaagagcattagaagaggtggttggatggagccaggctcaggctgcctcttcgttttagcaacaagaagactgctcttgactgataacagctctgtcaatattttgatgccacaataaacttgatttttctttacattccttttatttttcctttctctaaatttaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgagaaataatagatgatatgatttattacctttcaattatatttttctcagttatactagaaaatttcataatcctgggatatatgtaccattgtcagctatgactaaaaatttgaaaaagataaaaatttctagcaagcctttgaagtttaccaagtatagtcacattcagtgacagcccattcattccagtaaagaatcatttcattcactttgggagaggcctataattacatttatttgcaatgtttctcttcgctagattgttacatagctcccattctgttggttttgcttacagcatatggtaaccaaggttagatgccagttaaaattccttagaaattggatgagccttgagattgcttcttaactgggacatgacatttttctagctcttatcaagaataacaacttccacttttttttaaactgcacttttgactttttttatggtataaaaacaataatttataaacataaaagctcattgtgttttttagacttttgatattatttgatactgtacaaactttattaaatcaagatgaaagacctacaggacagattcctttcagtgttcacatcagtggctttgtatgcaaatatgctgtgttggacctggacgctataacttattgtaaagaccttggaaatgtggacataagctctttctttccttttgttactgtatttagtttgtgataaatttttcactgtgtgatatttatgctctaaatcactacacaaatcccatattaaaatatacattgtacctgaccctttaatcatgttatttatgccaccaaggttgtggatcttaaggtatgtatggaaaggaactcatttatcaaattgtaagtaatacagacatgccatttaaaagaggtaaattcttgttttctatattttgttagtaaattctcaatgaaataagttgaagtttcactggatttcattaacttttaaatattacatatatgtgttttctcagattagtgaaaattgtgaccttaaatttaatacacatatactgcctcagagtgctttcttgtatcaaaatttttgttttttaaaaaagtagataatatttaggagacagaaaaacctatacataatgtattcatgatttaaatttttttaagtcagcctagtttcttgttttaaaaatataacgtggaaacatgaaaagacttgatgcatataatattcaatgaactaataccagagacagctaagttttttcagtagttatgctgaataagcattttagtaggtaacttacaccagctaacatttgaacagcataataaatacttaatataacaacaactatgatcttatgatgataaaagggaagttagcatattttctatgtaaaattattcattttttaaaatagctgttaaacctatatttaatctttagattataatagcaaataatacagtatgctaaactatagtcacttgtaactacatttttgtttttgaaatttgatttctatttataaggtcttgaagaggcctacaaaatacagagcctttaaagaagacataacagtaaaatagaagtacacagttttatacgagtcaatgtagcaagtaacatttagacagtaagtttggttctgaattttctggctgctaaaacactttttgcttttcacagtaaaaaaacttatgtgcagaggctaatttcctcttgaactacagcatgagggtctgtatataggaacatttcttcagaatgtaaaaaagatgcaaaatggagacagaggttataatggtgcttcttaacccagtgaaggcacaacttaatgtcgtctaggaacattggtttagggtcagtctgtattttcagggatagaactaaagaaccagatgatcaatagctaagccagccttagcctgtcacatgttatacaccttcattgaatcatagatgggcattagatctcatttatttattaaacttctctatgcttttggaagaggtaagaatggaactaataaatcttaggcattattgccagaataatgctaattgctgtatatacagcctttaatctttgagatcagtgagaaaactttataaattgcttactaaaatgaaagccataaaatttaataacagaagacatgaaatttagcaatcttgtggaattcattacacagtattaactgtcacgcagggtaccccacacagtgtcccagtgttgaacacaaaatgcaaatctggaagggataaatatcttcaattcagaaacagcattaagtatacctgtataatactgtcaccattatcttccatctgcaattcaccgcatcatcccccaaatgcccacagatctattgcaggaaacctactaatcccaacatctaaagcatgtaggaataagatgtgatattccttttgtgtgtggggagagtgtcaatctaaacgtttaacaaaaggcaaagaatgttcacatttcacatcacaaaagagatttcaaagactcctttaacccgacagcgcttatgtcagtgtctttgtcatgtttcatagaattgttagactttaaaagaacctcctgaaagtctgcctctgaacatttgtatggttctgccaatgtctgatgagaagaatgcttccctgtttgaggagtgtgttcactgatgagaggggacgggagaagcctggttgtgatttcaggaataattctcaaaggagattatactcttattgcaaaatggggtctgctatatattgttcatgtcactttattgcaagtgacatgaattatatgacattaaaaataatatgccttgaatcacactgattagacccagaaggatcattgagtttttggtggttttaaagatccaagaaagacctatctagcccaagtgtatgaatgagaagactgaagcccacagaagtgaactcagcaccagtgtctcaagaaccccagtactctggtttttttcttttttgagacggagtctcgctctgtcgcccaggctggagtgcagtggcgcgatctcggctcactgcaagctccgcctcccgggttcacgctattctcctgcctcagtctcccaagtagctgggactacaggcgcccgacaccatgcccggctaatttcttgtatttttagtagagacggggtttcaccgtgttagccaggatagtctcaatctcctgacctcgtgatccacccgcctcggcctcccaaagtgctgggattacaggcgtgagccaccgcgcctggccttctgtttttgtttttctgtttttttgttttttgagacagagtctcgctctgtcacccaggctagagtgcagtggcgtgatctcggctcactgcaagctccgcctcccgggttcatgccattctcctgtctcagcctctcgagtagctgggactacaggcgcccgccaccatgcccggctaattttttgtatttttagtagagacggggtttcaccatgttagccaggatggtctcgatctcctgacctcgtgatccgcccgcctcggcctcccaaagtgctgggattacaggagtgagccaaggcgcccagcccagctgtacgttttaaaagtcaagcacttctgtttagcagcccatgtaagcttgtcaatcattctgaattgaaatgtaatttattctgtaatttcttcaatgcattatatttccccttttctttaaatgtatgtaacattgtgttctacagttttgctgccatgattccttggcaccgtgaattcttactaagcaatgtttgttaacagtatacaggctcgatactaggcaggaagagctcctgtgttcttgcttttttgatcttttttaaatctaaaggagacgtgtattctagaaattaaatatttgtgtgccatatctcttgagttttggagaatgattggagtttgagttactgtaaataacaagattatcttggatattttagttttctgcaaaatcacttatgttttatatacctctgctaataattcaaaactctgaatttgctttactttaactttttaaaaatgtatttttgcaattggtttaatgactaccaaagcctaaaaagctaatgactagggtgcatgtttagtatgcactgtctagtgtaagctttttaaaagcagtagatttttattagagatgaacttccaggccatatgagaatatgcttaatcctagatttggcattttatagaaaagaattttgactcttgaactagaattaaaaacttgttctgatttccttgcttgcctcaatttctaaagtctagaagtggcaaataatttagatcacttataccaacagaatctgtatttccttccggggcaaagttggcatttcctatccactagcttccaaaatacaataatcctagttatgataagggcaactttattttattacacttagaaccattttatgttttcaaattcattaatcttcaagtgaagatgaactaaagaaaaaaatgcgttttgtcccaggttgcctgcaggttgcagtctgctgcatccggtcactgaagaggcagtgaggactgtcacagagtgggctggagagccaagctgttctttcggggtgcacagtgcaccagccataacacagcttagaaacatggatgagtatacctcaagacaggtgaacacggagtggggagcaaaagaaggcagaaactcctctgagtttcacaagcatcaggcacagatcagggcacagaggaagaagaaagaaggtttaccactggtctgtctctgtaaattgttacagagcaattttactttgtgttatttaggatcaagaaacaagtgttatttaaaagttctcttaccctccaacctttgtcatact

SEQ ID NO: 4105 - DNA, 1569 bp, Homo sapiens
agtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgcgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacga

SEQ ID NO: 4106 - DNA, 3732 bp, Homo sapiens
gcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgccgctcggcttcatcgtcttcctgcccgctgtgctgctgctggtggcgccgccgctgcctgccgccgacgccgcgcacgagttcaccgtgtaccgcatgcagcagtacgacctgcagggccagccctacggcacacggaatgcagtgctgaacacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccggcaattcatggagatcgagccggagatgctggccatggagaccgccgtccccgtgtactttgccgtggaggacgaggccctgctgtctatctacaagcagacccaggctgcctccgcctcccagggctccgcctctgctgctgaagtactgctgcgcacggccactgccaacggcttccagatggtcaccagcggggtacagagcaaggccgtgagtgactggctgattgccagcgtggaggggcggctgacggggctgggcggagaggaccttcccaccatcgtcatcgtggcccactacgacgcctttggagtggccccctggctgtcgctgggcgcggactccaacgggagcggcgtctctgtgctgctggagctggcacgcctcttctcccggctctacacctacaagcgcacgcacgccgcctacaacctcctgttctttgcgtctggaggaggcaagtttaactaccagggaaccaagcgctggctggaagacaacctggaccacacagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctacgaccagctgaagcaagtgatgaatgcgtacagagtcaagccggccgtctttgacctgctcctggctgttggcattgctgcctacctcggcatggcctacgtggctgtccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatcgcc

SEQ ID NO: 4107 - DNA, 5298 bp, Homo sapiens
gggtgcgtgtggagaggcccaggtgaggagcaagcgcccgcgttccggaagcccgctcccggggccatgggggcacaggtgaggctgccgcccggagagccctgccgagaaggatatgtgctgtctctggtctgtccaaactcctcccaggcttggtgtgagatcacaaatgtgtcacagctgctggcttctcctgtgctctacacggacctgaattacagcataaacaacttgagcatttcagcaaatgtagaaaacaaatacagtctttatgtgggcttggtactggcagtaagctcaagtatttttattggctccagcttcatactgaaaaagaagggcctcttgcaactggccagcaagggctttactagagctggacaaggtggacattcttacctgaaggaatggctctggtgggtaggattgctgtcaatgggagcaggagaggctgcaaattttgctgcttatgcttttgcacctgccaccttggtcacccctctgggtgctttgagtgttctcataagtgcaatattatcttcctactttttaaacgagcacttgaacattcatgggaaaataggctgcatattaagtatattggggtcaactgtgatggttatccatgccccacaagaagaggaagtcacatctttgcatgaaatggaaatgaaattgagagacccagggtttatttcctttgctgtgatcataactgtgatctccttggtgctgattttgattgtggctcccaagaaaggacagaccaatatattggtttatatttcaatctgttccttgattggagcgttttcagtttcttctgtgaaaggcctgggaattgccattaaggagctgatagaatggaagccagtttacaaacatccgctggtctttgttttgctggctgtacttgtgctttcagtaactacacagattaactatctcaacaaggcactggacacctttaatacctctcttgtgacacccatttattatgtattcttcacatccatggtagtgacttgctctgccatcttattccaagagtggtatggcatgacagctggagatatcattgggaccctgagtggattcttcactattatcattggcatcttccttctacatgcttttaaaaatactgacattacttggagtgagcttacatccactgctaagaaagaagccgtctctctgaatgtcaatgaaaacaattatgttttactagagaacttggagtgttcagccccaggatacaatgatgacgttaccttgtttagtagaactgatgactgaagtctctagaaacactgagttttaaccaatatgagacacacgaagaggaaaatgaatgcttgcttcttggaagaactgctaggaaagttagcatttttgcagttctaactaatttagatgtgaggccaagtaaaaatgccatttttttggccattgaatttgaaaatcaaattgattatcctccagaatctctacaaactttgaaatactctctaaggatcaaagaagtcaaagagctatgtgtgtctcagaataatctccttcttctggtcacagtatctttgtctctgccaggtggctcttcatttctttggtagctatttttagacttacagtcattcaccaatatacagttagcagtgttctgatagacacagtatcagtcatattctccgttgagtcataatttcaaactcaacaagatttcagaaaggtataatcatgtaatttctcatattaaaactgagaagagaggccaggcatggtggttcacacctgtaatcctagcagtttgggaggccaaggcggacagatcacttgagctcaggagttcgagaccaccttgggccacaaggcgagaccctgtctctacaaaaaatacaaaaattagccaggcgtggtggcacatgcctgtagttccagccacccgggagcctgaggtgggaggattgcttgagtctgcgaggttggggctgccgtgagcccagattgcgccattgtgctccagcctgggtgacaaagcaaggccctgtctcaaaaaagaagaagagaaagggccaggggcttttgctttaaaaaactttttttaaaacagaagtgaaaccacgggtgctttgttcttccttctgcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcatttccacagttctattaaacaatgactgatgttcacaatgacaacctacctgagatggctgcaaggccctaatgttccattatacattatagtcttttcagcatagtttagtgttgagtgcaattctaatgcattctacgtttttgaaaatcgataatccatggaaggtccatgggttgatacctcaggtcaaaaatgtgtttactctgttgattgctgtttcactttacttgtatatcagatatataagctatgaacacaagtttgtagtaaaagtatcttctgtctgggcaatggctcacacctgtaattccaacactttggggggctcaggtgggaggatttctagtccccaggagtttgagaccagcctgggcaataaactagaccccatgtctctaaaaaatgtaaaaaacatcaagaggctgagtcaggaggatcatttgagcttaggagttcaaggctgcagtaagttatgattgtgccactgcattccagcctgggtgacaagagtgagaccctgacccaaaaaagtatcttctgataaagtggcatttgaaaattgcagaaattttaatattttttcttttaatattaagaactttattgatctctctaggacaccttggtgaggaaattaatggcacttttcttgacatccaacctgggactctggtgattctgtgttctggcgaatttaagtttcagacatttctttgtgtcaccttttacaaggtgtttgcccttggtacgttatgaccaggtcaaaggttcccaaacacaaggctcattgtgtaccctggacaggaaattgaactgatgttgacatgtatgcatgcccaggaggaagactgggaaagatttaatgagttgaagtatgctgagaaacaatgaaatatttgaaaactgtctacataaaagttactgatgcacatgcattaaaaaaaaaaatgttgttgcaaatctaacactaaaaaatttttgactgggtgcagtggctcacacctgtaatcccagcactttgggaggctgaggcgggtagatcacaaggacaggagttcaagaccagcctggccaacatggtgaaaccccgtctctactaaaaatacaaaaattagccaggcatggttgcgggtgcctataatcccaactaccccggaggctgaggcagggaattgcttgaagcaaggaggggcaggttgcagtgagccaagattgtgccaccacactccagcctgggtaacagcaagactccgtctcaaaaaaaaaaaaaattcccaaataggaagatattttctaaggaagaataaaatgctggacccctatattcagactattagtcttaactggtagtttatgtatatattttaatactttgtcatcatgtacatatcttaagatttattatgtgaatatctgcatgtgtgttattaaggattacaaagttgtgctcacacaggacaaatggaaagattttcctacttctgtaaagataagtttcattatacttttgtcttacaattttattcttaggtcaatggttatttattataagttcagattgcacaattttcataagaccctttggatttagcacatgaaattaacacatattttaaagtattaaatacatggaaagcatctggcattatgcctgataataggcacttagtaaaatgtacttttctttgaatcaacatttgaattcttacagtcttgtcactagagacttaaaaggaccattgagtgcctatttttatacattcatcttttctcaatttgtcacattatctcattttaaataatgcaagtgaaagtgaattcatcatactatctcaacaccaatacaaaattattccaataaaaatatttttcttaataaaaccagaaaaactgaactaaatgctatttagccccgccaacaaagctttgtggaaaaatatatgaatatatgaaatgttctcaaatattttgaataaactgttcatgaagccttatattttgcaagtgtttttactgttgattttagaaagtttataaatcttaaatgtttgtatatttttcatttgcaataaaatgttatttaatta

SEQ ID NO: 4108 - DNA, 4581 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgacacaaccccagagagaaaggcttggagggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctaacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtgatgttttcttcagctgtatgattctatcatacttgaaactgaagaaaaatttaatatcctatgtcttttttatagatcttataatttatcaagtggatttatatgtcttattctccatataagtctaaaaaatcacatttaaattcttagtgatagtttcactacacatcatttcttcccaaagtcattacctcaagctttgtaaattcttctagataaaaggagagttgtgattagagaactgaatttcagccatttaaacctgtagacatagaaaacaacccagtggtcaaacctgagcttcaagaggaagcccaagtcctcctgtttcctgaatggcttttccactccaattcatcacatatctgctaagacacatttgcaggtagaatccataataatatctgttatttatgatctacctaatatttaaaggagaagaaaagaagtagccttcgttgcagccaacatccaacaataagtcccacccttaatgacatttcaaagccttcagatcacttctgacatgtctgtccaatatcattccaatcaatagtcttgcatttaaataggttgtttaactcggtggtattgagactgtaaccttaatggctcaggtcttttagctttgttctttgtcataatctgcactcctggccagactgaccaaacctggctgcaaaggaaagagatttgaattgatcaccaatgtatgaaaaatacagaacccatgtctggctcctaaactcctggtaataattcccgccatcgtagcaagtgtcccatgcattcagataaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgacagagtaagactgtctcaaaaacaaacaaacaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaa

SEQ ID NO: 4109 - DNA, 5481 bp, Homo sapiens
aattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaagctgccctgaggagtaagtaccgttaataactccattttacagttgaggaaacaaatgcccaaagatatgtccgagtcacagtgtcatgaaggacagaggctggattcaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcataaggatcccctagaagcatatgtaaaatgcagattcctgcaccccaactgcagacactgttaagtgggactggagtggggcccacgggtctgcattcttaactggtaccaccagtgattctgatgcgatgcttcaatcccgagatttcacatctggaaagcctaagaatttacaaagatgttctgctaaaacccccagggccccatgcagtcttgctagaaaatttcctccctagggttcctttggaaggttaaatactccccataggatctgtggcatttctccatccaatgaatactacttagagctacactcaccacttccctagacagcctttaataggcatgataacagtgttaatagaccagtgtgatagatcacttatctttatggattgtgcttaatactgatttagtatcttgactccaaaaactgacatctgttgtctgtgataaccacttctgtattgcgtcttaaccacttctgtattgtgtggtcttaactgcctaaggcggcaatgggcagtgggcccctttcccttaggatgggtatcaattcaacaatatttataaggcatttactgtgtgctaagcatttggaagacccaggctacaaaataagacatagttcctgccctccaggccagcagagggaggcacaaatacccaggaatctctgatgggtgtgaagtgcggtcgtgggccacagaaaatgaccgtcatggagaccctgctaaaggtcggaccctgagcccaaaggggtattcagaagtggagatgattttggccccactcatagatgggtggcaaatctaagatttgtataaagcatataaaatagggtgatcacccccgaggcagaggggccagcatttgcaaaggcacagagctaagaggagctgggcaaagaaaggaaagccagggaaggtggtgggagatgagtctcaaagctaagtagtggaagctgggcacagtggctcatgcctgcaatcccagcactttgggaggccaaggctggaggatcacttgagcccaggagttttatatcagcctgggcaacatagcaagacctcatctctgctaaaaattaaaaataaataaattagctgggtgtggtggtgcatgcctgtgatcctagctactcaggaggctgaggtgggaggatcgctagagcccagagagccaaggctacagtgagccatgatcatgctactgcactccagcctgggtgacaatgagaccatggctcaaaaaaaaaaaaaaaaaaaagataagcagtggaggccgaatcatggagggtcttgaatacctggctaaggagtttaaagtgtatccaagaggacgtgggagccactgatggttcatgaggaagagaagggcaggaccagcactgattgaaaaggagggcttgttcagtgtggaggaagaatcagaagggggaataagttaccttctccgagcctgcaagaacaaaaaacaaaaagcagaaattaaaatcaggtttcactgctatttatatatttctcctttcccaaatgatttttctaaagctgggagtggaggcaggagggagaaacagaaggtgagcagggaggctatttagatgtgtcaaacccgggtgatcattaataatttgggcatatatatgctcccaaacttactctgcccccttccttcccttttttttttttttttttggtatgggccttttaggcttgggccagccagctttcttgagatgagtgaataaaagcgtattgtaatttcatgtctgcttcagatcatggggacagtgccacccaggaactgctgctgaggcctgggaagctcccttgccttcgggtttggagcagtggcatcatcccaccaacctgagccatgaaagggctgagcagaaagttaaatggtagtttcctgactggaagccacacgtaggtcacttgagtagtcaggaagcacagtgggtgtggagccatcatctgtcttgggctggttcctcccaatctttgtccagtggtataaatggactgtctgctgatggccatacgcagcactggctgttaagatggggaaggggtacatcaggattccactcatagccctggttcgttattgttactcatggctctgacgtccccaagccctcttgaatgttgcaagcaatgttaaatatcacacctcggtctccttttgagcagcccaggtacctaaagcaaggtcaccaaacttgggtttaaacttcagttgccatcacagcagggttcaggttatgcagtttttgcagtgtggagttgaacgctgggtaaagaagggagagctgactctccattgcttttctagtggaaaccagccagtttgacggcacggtgcggatacaggactccatcaggctagtgttggggaaccagcccggcagccttccatgtgaattccaaagctgtttcaacactggctgataggcagacaaaaggttacttgtgtgtttctctgagaagcggtgtaaatgaagtcaccttagaatatattctgtgcggatgcttatattttgttaacttcacgacttatggcatgtcttatttaaaaaaaaaaaagtactaggtgcaaataacattatgaagtggtatttaattaaaaatccatgcagtga

SEQ ID NO: 4110 - DNA, 1676 bp, Homo sapiens
gatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaattaaa

SEQ ID NO: 4111 - DNA, 1757 bp, Homo sapiens
ggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttgtcttgctctgtcacccaggctggagtgcagtggtacaatcttagctctctgcagccttgacctcctggcctcaagtgatccccctgcctcggcctcccaaagtgccaggattacaggcatgaggccctgtacctggctagaactgcatataattttatagctaaatagagctgtggggaatccatccttcctgaggagaagcagacagaggcggaggagcaggctggtgtcagggctggtgaagcctgctaccgcgctgctcttgagtggcctcaggctaatgaccctccctccttaagccacgctgtccacttctctaaagggggggcctatgagaacatccaagtcacggaagggagtgggggttaaatgagatgtgcacaggtggctaatatgtgcatttttcttccaaccttcctactgtgtgccctaccaccgccacaagccatcaaccaaatagatacctgtcaccgaagacagggtttccttaattttttaacagctctgttgagatataatttacataccataaagttcacctgtttaaagtatacaattcagtggtttttagtatttcatagagttgtgaaaccatcatcctaatctaattttagaacattttgtcacccccaaaagaaaccctgtgcccattagcagtcactccctgttccccttttcccagcctcaggcaaccactaagctatcttctgtccctgtagatttgcctttttgaacaccttcataaataaagtcgtatgctttgtggcctga

SEQ ID NO: 4112 - DNA, 1711 bp, Homo sapiens
gcagctctgaattgggaagggatgaaggaggctgtgcctccgggttgcacgaagagtccgagtcatttctcagaaggttttgataggtgggccttagaggagacgccgccgagcaccgcaagaactggaaaacacacccctctctgtctgcctgggagagccacggaaattggcacttctctgagtgaagctgaggagaaggctgtaaatctgccaaaacagccttgaagtattcttttgtcatgaggaagtgacggctgctggagggaggtgaacaccacaaggagagatggcatctggcctgggccccgcctagcagcagctccacctcctaggccaggccctgtgggatgcgccactagaccaccatggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttggctccatgacagtggtgacagtcaaggccgtggctgggatgcttgtcttgtccattcaagggaacctgcagcttgactaccccatcttctacgtgatgttcgtgtgcatggtggcaaccgccgtctatcaggctgcgtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtatgcagaacatgcacgataaagggatgactgtccagcctgaacttaaagcttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatct

SEQ ID NO: 4113 - DNA, 681 bp, Homo sapiens
atggacggatcccacagcgcagccctgaagctgcagcagctgcctcccacaagtagctccagcgccgtaagcgaggcctccttctcctacaaggaaaacctgattggcgccctcttggcgatcttcgggcacctcgtggtcagcattgcacttaacctccagaagtactgccacatccgcctggcaggctccaaggatccccgggcctatttcaagaccaagacatggtggctgggcctgttcctgatgcttctgggcgagctgggtgtgttcgcctcctacgccttcgcgccgctgtcactcatcgtgcccctcagcgcagtttctgtgatagctagtgccatcataggaatcatattcatcaaggaaaagtggaaaccgaaagactttctgaggcgctacgtcttgtcctttgttggctgcggtttggctgtcgtgggtacctacctgctggtgacattcgcacccaacagtcacgagaagatgacaggcgagaatgtcaccaggcacctcgtgagctggcctttccttttgtacatgctggtggagatcattctgttctgcttgctgctctacttctacaaggagaagaacgccaacaacattgtcgtgattcttctcttggtggcgttacttgtcttgctctgtcacccaggctggagtgcagtggtacaatcttag

SEQ ID NO: 4114 - DNA, 2714 bp, Homo sapiens
cgtggctgggatgcttgtcttgtccattcaagggaacctgcagcttgactaccccatcttctacgtgatgttcgtgtgcatggtggcaaccgccgtctatcaggctgccttctccaagacagattcttcacctgctaatgagaacaacagtccctacctaagagaatcacatgaagctcttatgagaatgtctctagggaaatgcccggtttttgagtcaagcctcacagatgtacgactcctctttgattgccagtgtgggctacattctgtccacaaccattgctatcacagcaggtgcaatattttacctggacttcatcggggaggacgtgctgcacatctgcatgtttgcactggggtgcctcattgcattcttgggcgtcttcttaatcacgcgtaacaggaagaagcccattccatttgagccctatatttccatggatgccatgccaggtaaggttaaagccccgtgggtctagctgaacatccatatagaatgactgctacttcctgtttaaaaagagacaaccaactgctgtgctgtgcctttatcgtgtgactgttctctcactgtcttttttcttttctttttaattttgtgcaaaagggtaggcaatggctgaggcacctcggttggttttgagcacatcttgccagttctgtgtctatttggggatcttttaaataaaattctgattcatactcaatataattaggatctgcagccccaggcttcatgcctgcaaatggaaaaatccattcatctagttggaatgaaatgatcagaaaggggaaggagaatgagtggaatgaaattaaaatattataatctcactccctggatgccacaagggagtgcatcattctggaaagcctaatttcctagcgagctaaggattcataccgagaaacacaaatttaaatgtctgtaagccctgacagtaacataagcatgtgaatcagcccaatactgcccagcagggagtggtgggacctgcggaggactggagagtgcctgtctagcctaaaggaattcggattagaaaagttaagacattggaccaacctcagatttgctgacctaaactctgtaggttgctggtgaccattagctttcacacttaactcaacattttaattttatttatacaagatggaactctctctaaaacataatctcctgtccttcattaacacaatctcatgaacaaaatataaacacactgatggtctagaggactgcttactcgagaggttttcatgctgtaacgctgtgatgcaggtgtgttctcagggttgactggtgtgcccctacattaaatggccccagggtttatgtgtctactttttatattagttcctcctctctcgttattaagctgttgtctgtccttcttgctgtagccagcctgcctgagtatagcaactcaatgtcaatgtgctccttcaacccagcttgttcagattacaaataaaatcaaaatgaaggagctctgagttgggggcctaagatttctcctaggagttaagtgcatgagctttggtgcatgaactttttaaacgtctaatctggctgctcagattccttttttgctaacttccttgtttctcggctgtgttccggatagatgagggcgctggatagctgaattccagataggtgaggtgtcaactctgtgtgtgcaagtatgtgtatgtatatgtgtgtttgtgtgtttacaaactatgtgtatatatcaatatcagtatttgtgtgtgtatatatatatatatatagatgtattttctggtggaaaatagaaggtaacctaaggtagtcttagatatcaacattctgtggtatgtttgtgggtgtggctctcagctttttctttgtaccttgtgaccagtgggaagtcagctgttgaatcagggagaccctgcccttgcagtggcttgtcaggacacttccgattgtaggtgttctgtactgtgaagagcgtgggcttggagttcagatgacctggattcaaatcccaactctaccaccttcctgctgtgtgacctcccaaggcctctcatcctcacttgtaactgggattccttctttcaggctagtggtcatatgtgtaaaggcctcttgcacggtgtctgggacatggtagatgcctggttatatttggtttcacttcccttttgctttaaaaacctttggaagtttcacacacttgtttgacctggtggcaggtagaacatgcagaataaaactgctgaacagtctcagtctaaacagaggtgcttttccagccacttggtttccctggtcagcattaggatcttgccttttgtctacctagattcatatcttcacaacagacaactgctgttcaagaggtattcaaattccagaaatttaccacatcacaatttggagagcctttgagtaattcaagcacctgaaagacttcttaaaaatgagatcgagaaacagcccctgacctccaggaactagcctggcactctcagccaggccttggccctttcctgtggaacagaaacaatttcacagaacatcagcagcagacaaggccactctgcagctgtgatggatcaggacacaagcaggtggaatgggaagaaaagggtttttttcctaaaattaaaaataaataaataaataaaagaacacaaacaggactactctgctagcctgactaaacatagacaaaaaa

SEQ ID NO: 4115 - DNA, 5238 bp, Homo sapiens
aggcggggccaagatggcggcgcagcgcgcggcgggggcgacgggcggcgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgc

SEQ ID NO: 4116 - DNA, 3046 bp, Homo sapiens
gaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtc

SEQ ID NO: 4117 - DNA, 2010 bp, Homo sapiens
aggcggggccaagatggcggcgcagcgcgcggcgggggcgacgggcggcgggggccggggggcggtgggacgttgaccccgccccctgctgctgctagtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtctgc

SEQ ID NO: 4118 - DNA, 5173 bp, Homo sapiens
gaactggcccagaatcactctcgccctgctccggcgtctgcgccgggcggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggaatcatgttcgttcaggaggaggccctggccagcagcctctcgtccactgacagtctgactcccgagcaccagcccattgcccagggatgttctgattccttggagtccatccctgcgggacaggcagcttccgatgatttaagggacgtgccaggagctgttggtggtgcaagcccagaacatgccgagccggaggtccaggtggtgccggggtctggccagatcatcttcctgcccttcacctgcattggctacacggccaccaatcaggacttcatccagcgcctgagcacactgatccggcaggccatcgagcggcagctgcctgcctggatcgaggctgccaaccagcgggaggagggccagggtgaacagggcgaggaggaggatgaggaggaggaagaagaggaggacgtggctgagaaccgctactttgaaatggggcccccagacgtggaggaggaggagggaggaggccagggggaggaagaggaggaggaagaggaggatgaagaggccgaggaggagcgcctggctctggaatgggccctgggcgcggacgaggacttcctgctggagcacatccgcatcctcaaggtgctgtggtgcttcctgatccatgtgcagggcagtatccgccagttcgccgcctgccttgtgctcaccgacttcggcatcgcagtcttcgagatcccgcaccaggagtctcggggcagcagccagcacatcctctcctccctgcgctttgtcttttgcttcccgcatggcgacctcaccgagtttggcttcctcatgccggagctgtgtctggtgctcaaggtacggcacagtgagaacacgctcttcattatctcggacgccgccaacctgcacgagttccacgcggacctgcgctcatgctttgcaccccagcacatggccatgctgtgtagccccatcctctacggcagccacaccagcctgcaggagttcctgcgccagctgctcaccttctacaaggtggctggcggctgccaggagcgcagccagggctgcttccccgtctacctggtctacagtgacaagcgcatggtgcagacggccgccggggactactcaggcaacatcgagtgggccagctgcacactctgttcagccgtgcggcgctcctgctgcgcgccctctgaggccgtcaagtccgccgccatcccctactggctgttgctcacgccccagcacctcaacgtcatcaaggccgacttcaaccccatgcccaaccgtggcacccacaactgtcgcaaccgcaacagcttcaagctcagccgtgtgccgctctccaccgtgctgctggaccccacacgcagctgtacccagcctcggggcgcctttgctgatggccacgtgctagagctgctcgtggggtaccgctttgtcactgccatcttcgtgctgccccacgagaagttccacttcctgcgcgtctacaaccagctgcgggcctcgctgcaggacctgaagactgtggtcatcgccaagacccccgggacgggaggcagcccccagggctcctttgcggatggccagcctgccgagcgcagggccagcaatgaccagcgtccccaggaggtcccagcagaggctctggccccggccccagcggaagtcccagctccagcccctgcagcagcctcagcctcaggcccagcgaagactccggccccagcagaggcctcaacttcagctttggtcccagaggagacgccagtggaagctccagccccacccccagccgaggcccctgcccagtacccgagtgagcacctcatccaggccacctcggaggagaatcagatcccctcgcacttgcctgcctgcccgtcgctccggcacgtcgccagcctgcggggcagcgccatcatcgagctcttccacagcagcattgctgaggttgaaaacgaggagctgaggcacctcatgtggtcctcggtggtgttctaccagaccccagggctggaggtgactgcctgcgtgctgctctccaccaaggctgtgtactttgtgctccacgacggcctccgccgctacttctcagagccactgcaggatttctggcatcagaaaaacaccgactacaacaacagccctttccacatctcccagtgcttcgtgctaaagcttagtgacctgcagtcagtcaatgtggggcttttcgaccagcatttccggctgacgggttccaccccgatgcaggtggtcacgtgcttgacgcgggacagctacctgacgcactgcttcctccagcacctcatggtcgtgctgtcctctctggaacgcacgccctcgccggagcctgttgacaaggacttctactccgagtttgggaacaagaccacagggaagatggagaactacgagctgatccactctagtcgcgtcaagtttacctaccccagtgaggaggagattggggacctgacgttcactgtggcccaaaagatggctgagccagagaaggccccagccctcagcatcctgctgtacgtgcaggccttccaggtgggcatgccaccccctgggtgctgcaggggccccctgcgccccaagacactcctgctcaccagctccgagatcttcctcctggatgaggactgtgtccactacccactgcccgagtttgccaaagagccgccgcagagagacaggtaccggctggacgatggccgccgcgtccgggacctggaccgagtgctcatgggctaccagacctacccgcaggccctcaccctcgtcttcgatgacgtgcaaggtcatgacctcatgggcagtgtcaccctggaccactttggggaggtgccaggtggcccggctagagccagccagggccgtgaagtccagtggcaggtgtttgtccccagtgctgagagcagagagaagctcatctcgctgttggctcgccagtgggaggccctgtgtggccgtgagctgcctgtcgagctcaccggctagcccaggccacagccagcctgtcgtgtccagcctgacgcctactggggcagggcagcaggcttttgtgttctctaaaaatgttttatcctccctttggtaccttaatttgactgtcctcgcagagaatgtgaacatgtgtgtgtgttgtgttaattctttctcatgttgggagtgagaatgccgggcccctcagggctgtcggtgtgctgtcagcctcccacaggtggtacagccgtgcacaccagtgtcgtgtctgctgttgtgggaccgttgttaacacgtgacactgtgggtctgactttctcttctacacgtcctttcctgaagtgtcgagtccagtcctttgttgctgttgctgttgctgttgctgttgctgttgctgttggcatcttgctgctaatcctgaggctggtagcagaatgcacattggaagctcccaccccatattgttcttcaaagtggaggtctcccctgatccagacaagtgggagagcccgtgggggcaggggacctggagctgccagcaccaagcgtgattcctgctgcctgtattctctattccaataaagcagagtttgacaccgtc

SEQ ID NO: 4119 - DNA, 3168 bp, Homo sapiens
cggcggtggcggcggagacccgaacatggcgaccgcgcgcaccttcgggcccgagcgggaagccgagccggccaaggaagcgcgcgtcgtgggctcggagcttgtggacacttatacggtttacatcatccaggtcactgatggcagccatgagtggacagtaaagcaccgctacagcgacttccatgacctgcatgaaaagctcgttgcagagagaaagattgataaaaatctgcttccgcccaaaaagataattgggaaaaactcaagaagcttggtggagaagagggagaaggatctggaggtctacctccagaagctcctggctgccttccctggcgtgacccccagagtactggcccacttcttgcattttcacttctatgagataaatggcatcaccgcggcactggctgaagagctctttgagaaaggagaacagctcctgggggccggcgaggtctttgccattggacccctgcagctgtatgccgtcacggagcagctgcagcagggaaagcccacgtgcgccagtggggatgccaagaccgacctcgggcacatcctggacttcacctgtcgccttaagtaccttaaggtttctggcacagaaggaccttttgggaccagcaacattcaggagcagctcctgccgttcgacctatcaatattcaagtccctgcatcaggtggagataagtcactgtgatgctaagcacatcagagggctggtcgcatcgaagcccaccttagccacgctgagtgtccgcttctcagcaacctcgatgaaggaagtccttgttcctgaagcctcagaatttgatgagtgggagcctgaaggcacaaccctagaaggccctgtgactgccgtcatccccacttggcaggcattgaccacgcttgacctgagccacaacagcgtctccgagatcgacgagtctgtgaaactgatcccaaagattgagttcctggacctgagtcacaatggattgctggttgtggacaatctgcagcacctgtataaccttgtgcatctggacctgtcctacaacaagctctcctccttggaagggcttcacaccaagctggggaacatcaagaccttaaacctggcaggcaacctcctagagagtctgagtggcctgcacaagctctactcactggtcaacctggatctccgggacaacaggatcgaacagatggaggaggtccggagcataggcagcctcccgtgtctggagcacgtgtctctgctgaacaaccctctgagcatcatccccgactaccggaccaaggtgctggctcagttcggagagagggcctcagaggtctgtctggatgacacagtgaccacagagaaggagctggacactgtggaagtgctgaaagcaattcagaaagccaaggaggtcaagtccaaactgagcaacccagagaagaagggtggtgaagactcccggctctcagctgccccctgcatcagacccagcagctcccctcccactgtggctcccgcatctgcctccctgccccagcccatcctctctaaccaaggtaatcgtgtatgtatcttgcttctagtggagccacacagccctgcctgggccccctggctgggctggggttgggggagaggtgccagcacctgcttccaacagggtcagacacagggagggcagtgccttctgcaggctggtcctcgcggggggacacatggcaggggtgcctggcctgatgccagctgttgcttgcttggtgaggactcccaattgctctgatgcccacatccagctcctctaggagaccgcagggtgtctgacaggccctgaggctgccctctgaacaggctcggggctgttggctcatgggacccattccctcaccggcagcacaagcaggttggctcctggttacaggaagccgggcttgtgactttactgtctggagcccgaatccctgtgcagggaaaagcttgcttttatcactgcctcatctctgtggggtgacccagccccagaacaccatgtttgtggggccaagatgggccatctctgtccctgtggacccatggaagaccaggcccattcgtctgcccactatcttagcgttttcaaagggctttcacctctgaacccaggcatcctcggagatgagtgagtgaagcaggtctcatgagcgtgtctgctggcccggcccccacggaagaggggagggtgtgccgtcccgagtggagccgaggctcgggacacgcaggaaaggacgccgcctgcccgggctcctggagacgcagaacttggtgtgaggtcttgggaaaacagttcaacccgatgttttaagagccagaaaaacattcccaccccttgacctggtaaccccactggtggggattttctcttagagggataagataccgggaaggggaggtgaaatgctcaccactgccaaaacacgggctgcaactgcaacatcggaggatgagagggagagtcggctgtggtgcagaatgctcagcagccctcccagcagggacaggaagactgggcaggaagaggggagaagcattcaagttaaggcaaaaggcccaacgcagagcagcacactgaggtcacacctgtgagatgtggaagagaattcctgagcgtggagcgatggggttaggtgccaggatgattgcccattttgcttctgtcagactcttgactaaggatttctggttgcattttattacataaaagccagggaggttatatcacggtgagaaagcttccctgacgctgcctcctgtagcgcagccaagcgagcctgtggaggtaccatatgactgtaggcctctggggacagggagctgcatctgcttctcaaggccagggacacagccatttctgccagcatctgttgatcagtgagtgagtgagtgggcaggtagagcaggagccagtgaagagcaggccctggatgggtggggatgcaccatgtccccaggctgcagctgcaggcagccccccacattgtcggagaagcctctgcaccagctcagccccctcctcactccccttgtgccctggggacactctgcagaggggcactctgcagtctgtccccgccatcgctggacttctggacatggcctccagatttgcacctcttaaataaaactgcagtggatgtc

SEQ ID NO: 4120 - DNA, 3415 bp, Homo sapiens
aggatctgcgcctgcgcaaattgtaggtcaagcttgggccggggttagggttgcacacgcgtaaattgtgggccgccgctgccgggctgattgagaggacagctcccgcaatctgcggtcgtatccgttccgtcaatgttttatttctgcttgtttttcaatgttgttgcacaaataacgacacctgaaaacaaaaccaggtatacttattattaaaaagtgttcgtcctgtgaatccgcaacattgggatgctcaatttatttgcctttataaggaccaaaacacgaagctattttttatttttatttatttattattttttgaaatggagtctcgctctgtcgcccaggctggagtgcagtggagcgatctcggctcactgcaacctccgtctcccgggttcaagcgattctcctgcctcggcctcccaaatagctgggattacaggcaagggtcaccacgcccgggtaatttttgtatttttagtagagacggggtttcaccacgttggccaggctggtctcgaactgctgacctcaggtgatccacccgcctcggcctcccaaagtgctgggattacaggcgtgagccacgcgcccggccggaagctcctttctgtttttgttttgttttgtttttttgagacaggctcgctctgtcgcccaggctggagtgcagtggcgcgatctcggctcactgcaacctccgcctcccgcgttcaagccattctcctgcctcagcctcccgagtagctgggactacaggcgcccgccaccacgcctggctaattttttgtatttttagcagagatgggggtttcaccgtgtaagccaggatggtctcgatctcctgacctcatgatccgcccgcctcggcctcccaaattgctgggattacaggcgtgagccaccgcgcccgaccccggaagctcctttttaagtgtgatttattaagggcggcttgtgctagcagtgaggcgttaagcctgaaagtgaaaaaacccaaaacactcactgctcttttctgcccacctagctcaatcctccagtgcctttgccatagctttaagtaggttctcagtctcagagcttaaatcgcgagaactgacgggattagacgcaaaaccaaccaggacagctcccaagtacccacgcgctttcgtctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgtggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcat

SEQ ID NO: 4121 - DNA, 4355 bp, Homo sapiens
ctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctcatca

SEQ ID NO: 4122 - DNA, 3921 bp, Homo sapiens
gagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctc

SEQ ID NO: 4123 - DNA, 3765 bp, Homo sapiens
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttg

SEQ ID NO: 4124 - DNA, 4352 bp, Homo sapiens
ctggggctgtgaacgtggcgtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 4125 - DNA, 3921 bp, Homo sapiens
gagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctc

SEQ ID NO: 4126 - DNA, 3765 bp, Homo sapiens
gccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttg

SEQ ID NO: 4127 - DNA, 3921 bp, Homo sapiens
gagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctc

SEQ ID NO: 4128 - DNA, 4227 bp, Homo sapiens
cgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 4129 - DNA, 3765 bp, Homo sapiens
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttg

SEQ ID NO: 4130 - DNA, 5548 bp, Homo sapiens
aagttttggagcgccggacaagctgaggtccgcgactcgtcgctaagattccccaaaactgagatttcaagaaaattcaccctttccgctttctttggcgtccttcaaccgtgaaggaaatgaaggttgagaacctggaacccgcttccaatgaccaagccctttctctgtgcctcacaacagtcttccgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctgcaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 4131 - DNA, 3254 bp, Homo sapiens
ccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttt

SEQ ID NO: 4132 - DNA, 4290 bp, Homo sapiens
tttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgt

SEQ ID NO: 4133 - DNA, 3568 bp, Homo sapiens
aagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 4134 - DNA, 1349 bp, Homo sapiens
ggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagagagacaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatg

SEQ ID NO: 4135 - DNA, 2611 bp, Homo sapiens
gaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 4136 - DNA, 3451 bp, Homo sapiens
aactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagtgataatagagtgacatccttcagagacctcattcatgaccaagatgaagatgaggaggaagaggaaggccagaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 4137 - DNA, 2800 bp, Homo sapiens
ggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 4138 - DNA, 5289 bp, Homo sapiens
aggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaaattaaaaaataaaaaaaagaggtcactaaaagaccaagatgggaaacgtaacatggaatacaagcttgaatctgggaaacaagctcaaaaaacagtgaaaaaaaaagtactggtttaggagttcaaaattcagtgaaacaaactttttgccaatagacctagggatctaagaaatagaattagggagagtttacacttacttacctatatatcagcagatttttctggaagaaaccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtctgattagtgacataagtagcagccgtttttcaacttcagtttcattcactaccattgtttccaaattatcaatctctgctagtaattatgaatttaagaccatattattatcaaaaacctagagaccaatcatatatctgaaaagaaatacccattaaaaattctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttcctgtaatataaaagaaaaagttaatttatcaattgattgaatacagtttttactaattagtttatcaaaccaaatactgtgaacgtaccaggtgtttacagatttaaatgcatgttaccatagaaactattaaagtaactagaactgtcaaataacaaaacggctcatgtttttaaaatatatgtaactcattttaaaatatattaaattgtattccaaacctgttcttctgtttctgtggcacctaggtttaaaatatgtattaatgtgtaaatcacaagtaaaatgaattctaatgtacaagtttgttttaaaaagtgtatgtcaagcttttatttacacaataaaatgttattaaagatggaaagtctacaaatg

SEQ ID NO: 4139 - DNA, 2908 bp, Homo sapiens
attgagaatcactgcttttaaagggaaacacgtcattgtaaagaacacgttgtttagcttctgggactagaggcaaggaaaatatcttgcctagattacagcctttatacagttttatacttggaatagtcatggccttccttggtcatatttttggatgacaatcatctgtttttgtgaggaggaatgggatgggcagtaggagtcagcttaaatcgggctccgtgacagccaacgcagtgaccctcgccccttccttggcagcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaa

SEQ ID NO: 4140 - DNA, 811 bp, Homo sapiens
atttgaacagggcctgttgtaagtagttaatgtgtttgacaaccctgtaatatttgatatacctttggaaatgcatgagttactaatttttttgaaatctagttgtttgtaatgattgtcacttatgtctaatatcacaaaatattcaagaaattggagctgtgcaatgaacaataggacttctctttaaaaattgcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataat

SEQ ID NO: 4141 - DNA, 4687 bp, Homo sapiens
atgcacaaacattacaaagtccacttcgccaaggatgcccagagccccaacgggcactacttctgggacccagagttggggcaccgaaaaggatgctgtcatcagtggcgccaggactcagcggccctccgagcccatgggccctgtcggccttccccccaatcacactggcagctggcctaccacagccaccaagtgggtggcagtggctggcgccggggcctcctgccctccgtcctgcagcagcagcggcagccccagtcccagccctcacctcccagccccctgcggcagcggctctgccccattcacgaagcccagaaggggctgcctgcaacctccactgtccccaaggaacctgccagcgcccctcaggcgcccaccttacccaccacggcaccagccatggccaggagtggcccagctctaccctccgcggctggcgtcctcctgaagcccagcgagcccactgatgcccggcccctgcccgccccagcggcctgtggctccttcactgcctacagctccgacatcctgacagaggatgacgtctactgcagctgcctggccaagacactctgccacgtgccggtccctgtgaccgtgggtttctatgcccctttcggctgccgcctgcacatgatgctggacaagatcacggcgctgatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgacaacagccgcgagctgcacaccatgaccaaggcgttgcagaacgtgctcgacctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggttcctccatctgcccagatgggagaatagggggctggactggggccgcaacccagggtccgaatgagccctgtgaggcccacacccccaggtgaacctgagccagagccgtggacatagcttccaaggagtgcggccacaagccggtgccagcatgagagcaggcacagaaggaccagtgaggaagtcagggtatacatgcaataaatggaggtgttgagagcccggagttgctctccgcatcctgatctgaccagggaccaggcctgccccgtcctgccacagggcctgccccatcctgctaagcccacttactcctctgcaccatgctggcctcctcatctggcatctctgtggcaggagaggctgcgggggtggtgggtgaggctgcagagatgacaggtggatgggccaggttgactcaggcaacatggagcgcccaggcctcagggaatcccagtccttgtccccatgccctagcttgcccctctgtgagtagggcaggggctggcatttctgaggatgacctcggtgacctcagcaagctgctccacccctagggtggctccattctcaacgtaatgggttagacctcgctggcacctcagccagctggagtgggtggcactaacctcccccagacaaataactgtccacagggtacctgccttacgagtcactccagggccactggttagtcactgacactgaagccactgcatcagccccctgatgaggacagggaagttgggcagagatggggacatacagggcccaagccacagccagccaggaggggttacactagggctcccccactttccctctgggcagagccctgggctgggggtgggtgtcactcctctgggcagttcctgattcctcactggtcaaatgttcagccacacgctcaggccctggggtgcctggcccagttccaagtgtgtgccggcaggggccacaagggccaacactgaacataccctgggatgaggctgagggtgtggcttctgagccagggccctgaggctggtggaggggacagcccccgaggaacctgagagctctgcaaaggcacacaccctcaggccatgggactgggtcactgacctcacagttctttagttccaaggctgggcatagcatccaggtctggctgcagcaccggagttctctggccacagcaattgtcacaggtgcatgcaggtcagtgggagccctctatgatcttccctggggctgggcaagcagaggtgctgtttcccattcctggactgactaagctggtaggatacgcctggacctcctgggagctgtttcccagcagtcagggagagctggcctcagagggagaaggatggggcctcgtgacaccgttaagtctgtttctgtagatgtgtggttggggtcaatatatccctgtagcctcccttaagccagtttcagttgggtttgtttcttaccacctggaatccaagctgaaaataaattttcactcctgttaccaggagtggggtgctgtgagagatgctaacgtgtagacttggctggaggtgagggcaggactgaagccccccatgcctcagtaagaagctgcatcagcctggccaacatggtgaagccctgtctctaataaaaatacaaaaagattagctgggcatggtggtgcatgcctgtaatcccagctactcaggaggctgaggtgggaggatcacttgaacccgggaggtggtggctggagccaagatggtgccactgcactccagcctgggcgacagagcaagactccgactgattaaaaaaaaaagccgcagcctctgttacgtggtacaagctgtggccaaactgttggtcactgtatcttcacgtggagctgctatgagaacttgcacctgtgtaaagccacgggaccgttgtcacgaacaaaaaaggagcacggctgacctgtgcgcctttcccagcaatgagtcagggagcaggtttcccttctccactcccttcccccatctgcccacttgatccgggatccttgaggccctggggagcaacagagccctaagagcttcaaaggggcctgggtccaggaataacttggtgaagagctgcctgccactctgaacatccacatgtgacaataaacatctcctgtgttagga

SEQ ID NO: 4142 - DNA, 1596 bp, Homo sapiens
atgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaa

SEQ ID NO: 4143 - DNA, 2080 bp, Homo sapiens
agcccagcgagcccactgatgcccggcccctgcccgccccagcggcctgtggctccttcactgcctacagctccgacatcctgacagaggatgacgtctactgcagctgcctggccaagacactctgccacgtgccggtccctgtgaccgtgggtttctatgcccctttcggctgccgcctgcacatgatgctggacaagatcacggcgctgatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgacaacagccgcgagctgcacaccatgaccaaggcgttgcagaacgtgctcgacctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggtt

SEQ ID NO: 4144 - DNA, 1109 bp, Homo sapiens
atgcggctgcgcttttggctcctcatttggctcctgctgggatttatcagccatcagcccacccctgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctcc

SEQ ID NO: 4145 - DNA, 4379 bp, Homo sapiens
gtattgagcgaggcaccgggacgtcggcggctggcggagccgggcgggcgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggccgatgctgccaccacccagccttctctttattttcagtgctttttgtttggcctccctgcccccatgtttttctggctgggagctcttggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcatggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagc

SEQ ID NO: 4146 - DNA, 5389 bp, Homo sapiens
gcagaggttgtgataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgtttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgtttattatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcaattcccctccctcagcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctaacaatgacaccagtcttttttttttttttcttttttgtttcccttttagagacagggtttcactctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcaggtggatcacaacgtcaagggattgagaccatcctggccaacatggtgaaaccccatttctgttaaaactacaaaaattagctgggcatggtggcgagcgcctgtaatcccagctactcaggaggctgaggcaggagaatcacttgacccaggaagcgtaggttgtagtgagctgagatcgtgccactgtactccagcctgggcgacagagcaagactctgtctcaaaaaaaaaaaaaagatgtggtcttgccatgttgcccaggctggtctcaaactcctaggctcaagtgatcttcctgccttggttcccaaagtgctgagattacagctgtgagccactgcacctgaccttttttttttcccccctccttttttttttgagacaggttctcactctgtcacccaggctgaagtgcagtggcatttgaggtcagtctcaccttgacctccccaggctcaaacaatcctcccgcctcagcctcctgagcagctgggactacaagcatgtgccaccatccctggctgattttttaaatttgttgtagagatgaggtctcactatgttgcccaggctggtcttgaactcttgggcccaagcgatcctcccgcctcagtgctgagattgcagtggtaagccaccatgtccagccaactctttaataataggcagttctgactggtgtaagttctgactggtatctcactgtggttttaatttgcatctctgatgattagtgatgttgggcattttttcatgggttttttgtttgtttgttttgagacaaagtcttgttctgttgcccaggctggagtgcagtagtgtgatctcagctcactgcagcctccacctcccgggttcaagccattgtccagcctctgcctcctaagtagctggaattacaggtggctgccaccacacccagctaatttttttagttttagtagagacagggtttctccatgttggccaggctggtctcaaactcctgacctcaagtgatccacccacctcggcttcccaaagtgctgggattataggtgtgagccaccgcgcccggccctcatgggttgttttgttttgttttgagacggaatctcaccctgtcacccaggctgcagtgcaatctcatgatctccacttactgcaacctccacgtcctgggttcaagtgatactcctgcctcagcctcccgagtagctgggactacaggcgtgcacccacgcctggctaatttttatatttttagtagagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgt

SEQ ID NO: 4147 - DNA, 2365 bp, Homo sapiens
gcggagccgggcgggcgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctga

SEQ ID NO: 4148 - DNA, 2271 bp, Homo sapiens
gtcggtaaggagacgtagctttccgtggggtgtaccactgcagttggttcccggcgggagacgcaggggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaagatagggaaactgaagctctgtgatttgtccatgattctgcaacaggagagtagcaaatcagaaagtactgtgcctgatcttttaactcccagcccaatgtgctcttctactcatgttatttaa

SEQ ID NO: 4149 - DNA, 3728 bp, Homo sapiens
gtcggtaaggagacgtagctttccgtggggtgtaccactgcagttggttcccggcgggagacgcaggggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaa

SEQ ID NO: 4150 - DNA, 3833 bp, Homo sapiens
gactcttcccctaccacgctcccgcagaggctgaggaggcggtttcgacttctcctccggctttctgtcttcggcactgtgtgcttcttgctccgcggtttatttctgtacctagtcctccctcccctcttcggtccatctccaaagcccgggcttggcggggactcgccctccgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggaagctgtcagccttgtccaagagttagtagacaaaagtgtgtctgtggcaaaaaagtagctgaaagaagttgtgcaagtccactatggcactgtgatcaagtatgtggaaaaacactgccatgtggtaatcacacatgtgagcaagtttgccatgttggtgcttgtggagaatgtcctcgatctgggaaaaggttctgtccatgtcagaaatcaaagttttctttgccttgtacagaagatgtaccaacttgtggagacagttgtgacaaagtacttgaatgcggaatccatagatgttcacagcgttgtcaccgaggtccctgtgaaacatgtagacaagaagtggaaaagcattgtcgctgtggaaagcatacaaaacgaatgccttgtcataaaccttatctgtgtgaaactaagtgtgttaagatgcgtgactgtcagaagcatcaatgtagaagaaagtgttgccctggaaactgtccaccttgtgatcaaaactgtggacggactttaggatgtagaaaccataagtgtccatctgtctgtcacagaggcagttgctatccctgcccagaaaccgtagatgtgaagtgtaattgtggcaatacaaaggtgacagtgccctgtggccgagaacgtaccacaagaccacccaagtgcaaggagcaatgcagtcgaccaccaacttgtcatcatacaagtcaagaaaaacatcgctgtcactttggttcttgtccaccatgtcatcaaccttgccaaaaagttttggagaaatgtggtcacttgtgtcctgctccgtgtcatgatcaagcattaataaagcagactggcaggcaccagcctacaggcccttgggaacagccttctgagccagcatttattcagactgcattaccgtgtcctccatgtcaagttcctattcctatggaatgtcttgggaaacatgaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgatactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgatacc

SEQ ID NO: 4151 - DNA, 5424 bp, Homo sapiens
acgcctgtggattggctgatggagctgtgagccggctgtagttgagcgggaacccgagacctggcagtcgccatgactggctgtccggcgtcatcaagacgccgaggcttcgggctctttttcttcttgcgtctacaccgcctcctgttgttgtttctggttttgcgtgggaccctggccaacaaacttaacgtgccacaggtgttgctacccttcggccgagagccaggccgggtgcctttcctgctggaggcccagcggggctgctacacttggcattccacccatcatgatgcagttactgttgagcctttatatgaaaatggcaccttgtgttcccaaaaagctgtactcattgctgaatctacgcaaccgatacgcctcagcagtattattcttgctcgagaaatagtgactgaccatgagctacgctgtgatgttaaggttgatgtgataaacagcattgaaattgtatctcgggcccgggaactttatgtagatgattcgccactggaactgatggtgagggcattggatgctgaaggaaatacttttagtagtttggcagggatgatgtttgagtggagcattgcccaggacaacgagtcagcaagagaagaactgtctagcaaaattaggattcttaaatactccgaagcagaatatgctcccccaatatatatagctgagatggaaaaagaggagaaacaaggagatgtgattttagtgtctgggattagaactggtgctgctgttgtaaaagttcgaattcatgaaccattctataagaaagtggcagcagccttaatacgtctgcttgttttggagaatatatttcttataccatcccatgatatttatctcttagtaggaacatatattaaataccaagttgcaaaaatggttcaagggagagtgacagaggtgaaatttcccctggaacattatatactggaattgcaagaccatagagttgcacttaacgggtctcattctgagaaagtggctatactggatgacaaaacagccatggtgactgcctcacaactgggccagactaatcttgtctttgtccataaaaatgttcatatgcgatctgtgtctggactcccaaattgcaccatatatgttgtagagcctggatttttaggtttcactgtccaacctggaaaccgatggagtctagaggtgggacaggtatatgtcattacagtagacgtctttgataaaagcagcacaaaggtctatatttcagataatctcaggattacatacgactttcctaaggagtactttgaagagcaactaactaccgtgaatggatcttaccatatagtaaaagccctgaaagatggtgttgtggtaataaatgcatccctgacctccatcatttaccagaataaagatattcagcctataaaatttctaatcaaacaccaacaagaagtgaagatttattttcccatcatgcttacacccaaatttctggcatttcctcatcatcctatgggaatgttatatcgttataaagtacaggtagagggtggcagtggcaactttacctggacttcttctaatgaaacagtggtcatagtaaccacgaaaggagtggtgactgcaggtcaggtcagggggaatagtactgttttggcccgagatgtacaaaatccctttcgatatggagaaattaagatacatgtcctgaaactgaacaaaatggaactgttaccatttcatgctgatgtggagattggccagattatagaaatacccattgcaatgtatcacataaataaagagaccaaagaagccatggcattcacagactgctctcatttatccttggatctgaacatggataaacaaggagtctttactcttctcaaagaaggtattcaaagacctggaccaatgcattgttccagtacacatatcgcagctaaatctcttggccatactctggtaacagtaagtgtgaatgaatgtgacaagtacttggagagcagtgctacatttgctgcttatgaacccctaaaggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatgatggcagtgggcagacccggttacatggtcatcagatccttaaagtacatcagataaaagggactgtactgattggagtcaattttgtgggctattcagagaagaaaagcccaaaagaaatttccaacttgcccagatctgtagatgtggaactgctcctggtagatgatgtaactgtagtgcctgagaatgccaccatctataaccaccctgatgtaaaggaaacatttagccttgtggaaggatctggttattttttagtcaacagcagtgagcagggtgttgtcaccatcacttacatggaagcagaaagctctgttgagttagttccattacatcctggattttttaccttggaggtctatgatctttgtttggctttcttgggtccagcaacagcccacctcagggtgtcagacatacaagagctggagcttgatctgattgataaggttgaaatagacaaaactgtgttagtgactgtgagggttcttggctcttccaaacgcccattccaaaataaatacttcagaaacatggaactcaaactgcagttggcttctgccattgtcaccctgacaccaatggagcaacaggacgaatactctgaaaattatattcttcgagctaccactattgggcaaaccacacttgtggctattgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttctt

SEQ ID NO: 4152 - DNA, 2168 bp, Homo sapiens
tgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaa

SEQ ID NO: 4153 - DNA, 5889 bp, Homo sapiens
acgcctgtggattggctgatggagctgtgagccggctgtagttgagcgggaacccgagacctggcagtcgccatgactggctgtccggcgtcatcaagacgccgaggcttcgggctctttttcttcttgcgtctacaccgcctcctgttgttgtttctggttttgcgtgggaccctggccaacaaacttaacgtgccacaggtgttgctacccttcggccgagagccaggccgggtgcctttcctgctggaggcccagcggggctgctacacttggcattccacccatcatgatgcagttactgttgagcctttatatgaaaatggcaccttgtgttcccaaaaagctgtactcattgctgaatctacgcaaccgatacgcctcagcagtattattcttgctcgagaaatagtgactgaccatgagctacgctgtgatgttaaggttgatgtgataaacagcattgaaattgtatctcgggcccgggaactttatgtagatgattcgccactggaactgatggtgagggcattggatgctgaaggaaatacttttagtagtttggcagggatgatgtttgagtggagcattgcccaggacaacgagtcagcaagagaagaactgtctagcaaaattaggattcttaaatactccgaagcagaatatgctcccccaatatatatagctgagatggaaaaagaggagaaacaaggagatgtgattttagtgtctgggattagaactggtgctgctgttgtaaaagttcgaattcatgaaccattctataagaaagtggcagcagccttaatacgtctgcttgttttggagaatatatttcttataccatcccatgatatttatctcttagtaggaacatatattaaataccaagttgcaaaaatggttcaagggagagtgacagaggtgaaatttcccctggaacattatatactggaattgcaagaccatagagttgcacttaacgggtctcattctgagaaagtggctatactggatgacaaaacagccatggtgactgcctcacaactgggccagactaatcttgtctttgtccataaaaatgttcatatgcgatctgtgtctggactcccaaattgcaccatatatgttgtagagcctggatttttaggtttcactgtccaacctggaaaccgatggagtctagaggtgggacaggtatatgtcattacagtagacgtctttgataaaagcagcacaaaggtctatatttcagataatctcaggattacatacgactttcctaaggagtactttgaagagcaactaactaccgtgaatggatcttaccatatagtaaaagccctgaaagatggtgttgtggtaataaatgcatccctgacctccatcatttaccagaataaagatattcagcctataaaatttctaatcaaacaccaacaagaagtgaagatttattttcccatcatgcttacacccaaatttctggcatttcctcatcatcctatgggaatgttatatcgttataaagtacaggtagagggtggcagtggcaactttacctggacttcttctaatgaaacagtggtcatagtaaccacgaaaggagtggtgactgcaggtcaggtcagggggaatagtactgttttggcccgagatgtacaaaatccctttcgatatggagaaattaagatacatgtcctgaaactgaacaaaatggaactgttaccatttcatgctgatgtggagattggccagattatagaaatacccattgcaatgtatcacataaataaagagaccaaagaagccatggcattcacagactgctctcatttatccttggatctgaacatggataaacaaggagtctttactcttctcaaagaaggtattcaaagacctggaccaatgcattgttccagtacacatatcgcagctaaatctcttggccatactctggtaacagtaagtgtgaatgaatgtgacaagtacttggagagcagtgctacatttgctgcttatgaacccctaaaggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatgatggcagtgggcagacccggttacatggtcatcagatccttaaagtacatcagataaaagggactgtactgattggagtcaattttgtgggctattcagagaagaaaagcccaaaagaaatttccaacttgcccagatctgtagatgtggaactgctcctggtagatgatgtaactgtagtgcctgagaatgccaccatctataaccaccctgatgtaaaggaaacatttagccttgtggaaggatctggttattttttagtcaacagcagtgagcagggtgttgtcaccatcacttacatggaagcagaaagctctgttgagttagttccattacatcctggattttttaccttggaggtctatgatctttgtttggctttcttgggtccagcaacagcccacctcagggtgtcagacatacaagagctggagcttgatctgattgataaggttgaaatagacaaaactgtgttagtgactgtgagggttcttggctcttccaaacgcccattccaaaataaatacttcagaaacatggaactcaaactgcagttggcttctgccattgtcaccctgacaccaatggagcaacaggacgaatactctgaaaattatattcttcgagctaccactattgggcaaaccacacttgtggctattgccaaggacaagatgggaagaaaatacacatcaactcctcggcacattgaagtgtttcctccattcagacttcttccagagaaaatgacactgattccaatgaatatgatgcaggtaatgtctgaaggtggcccccagccccaatccatcgttcacttctccatcagtaatcagaccgtggctgttgttaataggagggggcaagttacagggaagattgttggcacagctgtggttcatggcaccatccagacagtaaatgaagatactggcaaagtcattgtgttttctcaggatgaagtacagattgaagttgttcagctaagggctgttaggatccttgcagctgcaactcggctcatcacagctaccaagatgccagtttatgtcatgggagtaaccagtacccagacccctttctccttcagcaatgctaatcctgggctcacattccactggtctatgagcaaaagggatgtattggatctagtgcccaggcattcagaggtttttctacagctcccagtagagcataactttgccatggttgtccatacaaaagcagcaggcaggaccagtatcaaggtcactgttcactgcatgaacagttcctctgggcagtttgaggggaatttgttggaactctctgatgaagtacagatcctggtgtttgaaaaactccaactcttctatccagagtgccaaccagagcagattctgatgcctataaattctcagctcaaactccataccaacagggaaggagctgccttcgtgagttctcgtgttctcaagtgtttccctaattcatccgtcattgaggaggatggtgaagggctcctgaaagctggttccattgcaggtactgctgtattggaagtcacttctatagaaccttttggagtcaaccaaacaaccataactggggtccaggtagcaccggtgacatacctgcgagtgagcagccaacccaagctatacacagcccaaggaaggaccctgtcagcatttcccttgggcatgtctcttaccttcactgttcagttttataatagtatcggagagaaattccacacacacaatacccagctttatctggctctgaacagagatgacttgctgcatattggaccagggaataagaactatacttacatggcccaggctgtgaacagagggctgacacttgtggggctttgggaccggagacatccaggcatggcagattatattcctgttgctgtagagcatgccattgagccagacaccaagcttacctttgttggagatatcatctgcttcagtactcaccttgtcagccagcatggtgaacctgggatatggatgatttctgccaacaatattctacagacagacattgtcactggagtaggagtggccaggagtccggggactgcaatgatttttcatgacatcccaggagtagtgaaaacatatcgagaggtggtggtcaatgcatcatcaagattaatgctcagttatgacctcaagacttatctcaccaataccctcaattcaactgtattcaagctcttcatcaccactggcagaaatggtgtcaatcttaaaggattctgtaccccaaaccaggccttggccattacaaaagtacttcttccagcgaccctcatgctgtgccatgtacagttcagtaatactttgctagacattccagcaagtaaagtctttcaggtccattcagatttcagtatggagaaaggggtttatgtctgcataatcaaggttcgaccgcagtcagaggagctgctacaggccctcagtgtggctgacacctcagtctatgggtgggctacactggtcagtgaacgtagcaagaatggaatgcaacgaatcctcattcctttcatcccagccttttatattaaccagtcagaattggttcttagccacaaacaagatatcggggagataagagtactgggagtggacagagttcttaggaagctagaggtcatctccagctccccagttctagtggtcgctggccatagccactctcccctcactcctggcctggccatttactctgtaagagtggtcaacttcacttccttccagcaaatggcatcacctgttttcatcaatatttcctgtgtactcaccagtcaaagtgaggcagtggtagtgagggctatgaaagataagttgggtgcagatcactgtgaagattccgccatcctcaagcggttcactggctcttaccagatcctgctcttgaccctctttgcagtgctggcatcaacagcttccatcttcctagcatacaatgccttcctaaacaagatacaaacagttccagttgtgtatgtaccaactctaggaacaccacagccaggtttttttaactccacaagttctccccctcacttcatgagtctacaacctccattggcccaaagtcggctgcaacattggttatggagtataaggcactaacctctgcttggacaagtttctcttaactgcaggggaatgaagatttctagtcctcgacaagaagcctaacagcaacttctacattaagtttccagataaggcttctgagaactataaataaagcatcctaagctgtttcttaaaactggt

SEQ ID NO: 4154 - DNA, 906 bp, Homo sapiens
ccggggaccacacgccgcgctgtccccagcacccaacccaggttaccatggcctccctgttctctggccgcatcctgatccgcaacaatagcgaccaggacgagctggatacggaggctgaggtcagtcgcaggctggagaaccggctggtgctgctgttctttggtgctggggcttgtccacagtgccaggccttcgtgcccatcctcaaggacttcttcgtgcggctcacagatgagttctatgtactgcgggcggctcagctggccctggtgtacgtgtcccaggactccacggaggagcagcaggacctgttcctcaaggacatgccaaagaaatggcttttcctgccctttgaggatgatctgaggagggacctcgggcgccagttctcagtggagcgcctgccggcggtcgtggtgctcaagccggacggggacgtgctcactcgcgacggcgccgacgagatccagcgcctgggcaccgcctgcttcgccaactggcaggaggcggccgaggtgctggaccgcaacttccagctgccagaggacctggaggaccaggagccacggagcctcaccgagtgcctgcgccgccacaagtaccgcgtggaaaaggcggcgcgaggcgggcgcgaccccgggggagggggtggggaggagggcggggccggggggctgttctgacccgctagggtggaggagaggagtggggtttgttgatgaacctccacccccaccccacccccgcacgcctgtaatcccagcacttggggaggccaaggcgggaggatcgcttgagcccagaggttcgagatcaacctgggcaagagagtgagaccctgactctacgaaaattaaaagttagcccggtgtggtggcgcgcacctgtggcttagctaccctg

SEQ ID NO: 4155 - DNA, 809 bp, Homo sapiens
cggccgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtgagctgggggatatgagggggttgggctgttccagtcctctgtctaccctctctgcctcctgcctgcaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggccagctccactccaggactgaataaaggtctttgacagctcta

SEQ ID NO: 4156 - DNA, 728 bp, Homo sapiens
aggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggccagctccactccaggactgaataaaggtctttgacagctct

SEQ ID NO: 4157 - DNA, 1701 bp, Homo sapiens
ccgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctat

SEQ ID NO: 4158 - DNA, 2458 bp, Homo sapiens
acgcagagagaaagttacgaggttcgtggccgcggtttccccaggcagctggcgctggaggcttcggcgtcacgtgctgaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataacttctgtttcatctagttcttgtttgtcaatgccttccctcccgctccccatcttctgaggcctgaaggatgttcctgccacatcaaactcctttaggcagagtaccgccactggatgtatagtttaatgtttcatctgatttttctttaaattatttccttcacattttgcttcacatgatcttgttgaagctaattttgaaaatggaaactatgttttcttgactttagaagcattagttttaagaggaaatttcagccactagtcaatagagatcaaaatcagtgaacaagagctgatactctcattttcaaaaattctgaattaaaaaaagtccaggaagttagtaatttaaatcagtatgttcatttcactctagtgaaactactatatgttgtaaattagttaaaaatggatgttcagaaaagaattgaaatcaggacaaaaaattacagatgctagtgaggttgtagagaaaaaggaatgcttatacgctgttagtgggagtgtaaattggtccaaccattgtggaagagagtgtagagagtcctcaaatatttaaagatatttgacccagtaatcccattactaggtatatacccgaaggaatataaattgttctattataaacacatactcacgtgtatgttcattgctgcactattcacaatagcgaagacatgaaatcaacctaaatgttcatcagtgatagactggataaagacaatgtggtatatgtacaccatggaatactatgcagccgtaaaaaagaataagatcatgtcctctgaaaagacatgggtggagctggaggccattatccttagcaaactaatgcaagaacagaaaaccaaacactgcatgttctcttataagtgagagctaaatggtgagaacacatggacatgggaacaacacattctggggtctattggagggtgggaggagggagaggatcaggaaaaataactaatgagtactaggcttaataccttggtgatgaaattatctgtacaacaaaccctcatgacacaagtttacctatgtaacaaacctgcacatgtacccctgtacttaacaacaaaataaacacaaaggaaaatgtt

SEQ ID NO: 4159 - DNA, 690 bp, Homo sapiens
gcgccattacgcagagagaaagttacgagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactc

SEQ ID NO: 4160 - DNA, 1755 bp, Homo sapiens
atttgccattcttagcaactggccagtcaacaactcaactttataatgggaaaactagacgagctgagattcaacccacgtgagcggctgcagagccgctacccttaacagctctctctcgggattctaacattcccttctgtgacggagagacagcaggccgggacacgcatcccaggacggatccacagctggatggggaaggctgcgccaggcgggccggaagcctggcggtggcgtgcaggagccccgccctcctgggctggattcagccgggggcggggccgcgggcggggcctgtggcagcgggaatcccgaccccgcccctttccccacccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 4161 - DNA, 1228 bp, Homo sapiens
ccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 4162 - DNA, 1416 bp, Homo sapiens
acccctccatttctcgccatggcccctgcactgctcctgatccctgctgccctcgcctctttcatcctggcctttggcaccggagtggagttcgtgcgctttacctcccttcggccacttcttggagggatcccggagtctggtggtccggatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttct

SEQ ID NO: 4163 - DNA, 1228 bp, Homo sapiens; identical to SEQ ID NO: 4161

SEQ ID NO: 4164 - DNA, 1755 bp, Homo sapiens; identical to SEQ ID NO: 4160

SEQ ID NO: 4165 - DNA, 1401 bp, Homo sapiens
tgaaagcggccgagaagctacaggggagggagacctgagttctaaattaggaactcaaggattagagttttggagaggcgggagagtgaggactgagggagccgaaaagggcggtgaccggagtattctaaatgcccgccagggatggctggctgccctgcaggaccgcagcatccttgcccccctggcatgggatctggggctcctgcttctatttgttgggcagcacagcctcatggcagctgaaagagtgaaggcatggacatcccggtactttggggtccttcagaggtcactgtatgtggcctgcactgccctggccttgcagctggtgatgcggtactgggagcccatacccaaaggccctgtgttgtgggaggctcgggctgagccatgggccacctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacata

SEQ ID NO: 4166 - DNA, 1755 bp, Homo sapiens; identical to SEQ ID NO: 4160

SEQ ID NO: 4167 - DNA, 1228 bp, Homo sapiens; identical to SEQ ID NO: 4161

SEQ ID NO: 4168 - DNA, 1755 bp, Homo sapiens; identical to SEQ ID NO: 4160

SEQ ID NO: 4169 - DNA, 1755 bp, Homo sapiens; identical to SEQ ID NO: 4160

SEQ ID NO: 4170 - DNA, 1401 bp, Homo sapiens; identical to SEQ ID NO: 4165

SEQ ID NO: 4171 - DNA, 1755 bp, Homo sapiens; identical to SEQ ID NO: 4160

SEQ ID NO: 4172 - DNA, 1401 bp, Homo sapiens; identical to SEQ ID NO: 4165

SEQ ID NO: 4173 - DNA, 1401 bp, Homo sapiens; identical to SEQ ID NO: 4165

SEQ ID NO: 4174 - DNA, 1755 bp, Homo sapiens; identical to SEQ ID NO: 4160

SEQ ID NO: 4175 - DNA, 1401 bp, Homo sapiens; identical to SEQ ID NO: 4165

SEQ ID NO: 4176 - DNA, 1401 bp, Homo sapiens; identical to SEQ ID NO: 4165

SEQ ID NO: 4177 - DNA, 1228 bp, Homo sapiens; identical to SEQ ID NO: 4161

SEQ ID NO: 4178 - DNA, 1401 bp, Homo sapiens; identical to SEQ ID NO: 4165

SEQ ID NO: 4179 - DNA, 1228 bp, Homo sapiens; identical to SEQ ID NO: 4161

SEQ ID NO: 4180 - DNA, 1228 bp, Homo sapiens; identical to SEQ ID NO: 4161

SEQ ID NO: 4181 - DNA, 1228 bp, Homo sapiens; identical to SEQ ID NO: 4161

SEQ ID NO: 4182 - DNA, 456 bp, Homo sapiens
atgggcaagaggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccaccggcctctgttttaagggggcagggcgtctgcaacaggagtggcacacggtga

SEQ ID NO: 4183 - DNA, 7857 bp, Homo sapiens
ctgggcccaaaacttgggtggaaggcagaggcctccgggaccctccccgccccctcctcccccccgccggctcccccgccctctcctccgcgcccctttaagctatccagcagacggagacagagttgatccaggaggggctggcagagtgctggagggggaaggctgggggcggagggaagggcggcaggagcccgaccggtcccacccctagctacaaccccgggcaggaagagctcgtcgcggtagcagcggtcgaaggggaccaagctccagagggcgggcgcccgagccgtgcggggagcgggcggggcagccatgctcctgtctgggggcgatcctccggcgcaggaatggttcatggtgcagacaaaatcgaagcctcgggtgcagcggcagcggctgcaagtgcagcgcatctttagggtcaagctgaacgccttccagagccgcccggacaccccctacttctggctacagctcgaggggccccgagagaacatgggcaaagccaaggaatacctgaagggcctgtgcagcccagagctgtggaaagaggttcgctacccaccgatcctgcactgtgccttccttggggcccaaggcctcttcctggactgcctctgctggagcacccttgcctacctggtgcctggcccccctggctccctgatggtgggcgggctgactgagtctttcatcatgacacagaactggctggaggagctggtggggcgactgcgctggggccctgcccctctgctgaccccccgggggatctgggaggctgaggtgacccgggcctttggggccctggtctggatccgtggtgaccagcatgcaggggacctactgcagctgcccccagcggtccaggagctgctgctgagcctggtgcgggatgctgcgggcaaggaagacatcatcgagtggctcagccgcttcggcatctctgactcccactccgatccggaggttctaatctgccctccccagcagcagaaggaagccccagccatggtgtccgtgggagagagtcctggaccctttgtggacatggggaccctccagaacaggggcccagaaaattcaaagagattatctagcctgggagccactgggtccctgatcacagcccagagcacaccgcaggaggcagcaaaccagctggtacgggtcggttccaacaaccaagatggtatggacagtgctcaagaggaagggacagtgcaagccaccagcagccaggactccacgaaccacacacaagccttgttgaagcaaaggcaggtccagaagatagaagataaactcctcttccaacctccagtatcagccctgggtgtgtgcccaccctggaaggcctggaccccggggccagcctttgggccattgtggccgggggctattgctgcaaccttctggaggatcaatgagctgcattctctacatctggcctggctcctgtcccaggcgtgcttcaatttccccttctggcagagacctctgggccccattcagttgaagctgccagggcagaatcctttgcccttaaatctggagtggaagcagaaggagctggctcctctgcctagtgcagaaagcccagctggtagaccagatggggggctgggaggagaagcagccctgcagaattgcccaaggccagagatttccccaaaagttacgagtttattggtggtccctgggagctcagatgtaaaagacaaagttagctcggatctcccacagatagggccacccttgacctctacaccccaactacaggctggaggtgagccgggggatcaagggagtatgcagttagattttaagggactggaagagggacccgctccagtgctgccaacagggcaagggaagcccgtggctcaaggggggctgacagatcagtcagtacctggagctcaaacagtgcctgaaactctcaaagtgcccatggctgcagcagtgcccaaagctgaaaatccctccagaactcaagtgccatctgcagctcccaaactgcctacatctcgaatgatgctggcagtgcacacagagcctgcagctcccgaagtgcctttggctccaacaaagccaacagctcaactgatggccacagctcaaaaaacagttgtgaatcaaccagtgttggtagctcaagtggaacccacaactccaaaaactccccaggctcagaagatgcctgtagcaaaaacatcacctgcaggtcccaaaacacccaaagctcaagccgggcctgcagctacagtttccaaagcacctgcagcttccaaagcacctgcagctcccaaagtacctgtgacccccagagtctccagagctcccaaaacacctgcagctcagaaggtgcccacggatgcagggccaaccttggatgtagccagacttctgagtgaggtccagcctacatcaagggctagtgtctccttactgaagggccaggggcaggctggaaggcagggtccccagtccagtggcaccttggccctcagcagtaagcaccagtttcagatggaggggctcctgggggcttgggagggggccccaaggcagccacctcgccacctgcaagcgaacagcacagtgaccagcttccagaggtaccacgaggccctgaatacacccttcgagctgaacctgtcaggggaacctggaaaccaggggttgcggcgagtggtcatcgatggcagcagtgtggccatggtgcatggcctgcagcacttcttctcctgccgaggaattgccatggcagtgcagtttttctggaaccggggacaccgagaggtcactgtgtttgtacccacctggcagctgaagaagaaccggagggtgagagagagccactttctgacgaagctacactcgctcaagatgctttcaatcacaccctcccagcttgagaatggcaagaagatcaccacctacgattataggttcatggtaaagctggcagaggagacagatggcatcattgtcaccaatgagcagattcacatcctgatgaatagttccaagaaactgatggtcaaagatcgcttgctgcctttcacctttgcggggaatctcttcatggtgcctgatgaccccctgggccgtgatggccccaccttggatgagtttctgaagaagccaaacaggttggacactgacattggcaacttcctgaaggtgtggaagacccttcctcccagctcagccagtgtcactgagctgagtgatgacgctgactctgggcccctggagagtctgccgaatatggaagaagtcagggaagagaaggaggagaggcaggatgaggagcagagacaggggcagggcacacagaaggcggctgaggaggacgaccttgactcttcgctggcgtcagtgttcagggtggagtgcccgtccctttcggaggagatcctgcggtgcctcagcctccatgatccccctgatggggccctggacatcgacctcctgccaggggcagcttctccctacctgggcatcccctgggatggaaaggctccctgccagcaggttcttgcccacctggcccagctcaccatccccagcaacttcaccgcactctccttcttcatgggcttcatggactcccacagggatgccatccctgactatgaagccctagtgggccccctgcacagcctcctcaagcagaagcctgactggcagtgggaccaggagcatgaggaggccttcctggccctgaagcgagccctggtgtctgccctctgcctgatggcccccaactcccagctgcccttccgcctggaggtgaccgtgagccacgtggccctgacggccatcctccatcaggagcactcagggaggaagcaccccatagcctatacctcaaaacccctcctccctgatgaggagagccagggcccccagtcagggggtgacagcccctatgctgtggcctgggccctcaagcatttttcccgctgcattggagacaccccggtggtcctggacctttcctatgcctcccggaccactgcggaccctgaggtgcgggagggccgcagggtttccaaagcttggttgatccgatggtccctcttggttcaggacaaaggcaagagggccctggaattggccctcctccagggcctgctgggggagaaccgcctgctcacccccgcggcctccatgcctcgcttcttccaggttctgccgcctttctctgacctgtccacgttcgtctgcatccacatgtcgggctactgcttctaccgtgaggatgagtggtgtgctggctttggtctctatgttctatcgcccaccagcccccctgtctccctttccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaagaggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatggagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctctcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctatctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaaatgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctgtccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactggagctga

SEQ ID NO: 4184 - DNA, 9144 bp, Homo sapiens
ggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgga

SEQ ID NO: 4185 - DNA, 8550 bp, Homo sapiens
cttttctgaaaacatcagcattctgccatatctggaataatggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctga

SEQ ID NO: 4186 - DNA, 8322 bp, Homo sapiens
atggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgtgagagaaaccattggtggggagtgctatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttcataacaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaa

SEQ ID NO: 4187 - DNA, 8428 bp, Homo sapiens
atggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttt

SEQ ID NO: 4188 - DNA, 10896 bp, Homo sapiens
atgggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtg

SEQ ID NO: 4189 - DNA, 651 bp, Homo sapiens
cggctcgggcggacgcggcggctgctgccggggagcgagccggcggcgcgggcgagccgagcgcgagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatg

SEQ ID NO: 4190 - DNA, 1085 bp, Homo sapiens
tgacttcatgttcattatcttctcttcattcttaaaaaaggaacacattttataaaagagtcctgactgataatgtgtcccttgaccttgcaggtcactggcctaatgaatgtctctgagccaaattccagctttgcttttgtaaatgaatttatactccaaggtttcacttgtgagtggacaattcagatcttcctcttctcactctttactacaacatatgcactgactataacagggaatggagccattgcttttgtcctgtggtgtgactggcgacttcacactcccatgtacatgttcctgggaaatttctcctttttagagatatggtatgtctcttctacagttcccaagatgttggtcaacttcctttcagagaaaaaaaacatctcctttgctggatgttttctccagttttatttcttcttctctttgggtacatcagaatgcttgcttttgactgtgatggcctttgatcagtaccttgctatctgccgtcccttgctctatcctaatatcatgactgggcatctctgtgccaaactggtcatactgtgctgggtttgtggatttctgtggttcctgatccccattgttctcatctctcagatgcccttctgtggcccaaacattattgaccatgttgtgtgtgacccagggccacgatttgcattggattgtgtttctgccccaagaatccaactgttttgctacactctaagctcattagttatttttggtaacttcctctttattattggatcctatactcttgtcctgaaagctgtgttgggtatgccttcaagcactgggagacataaggccttctctacctgtgggtctcatttggctgtggtatcactgtgctatagctctcttatggtcatgtatgtgagcccaggactcggacattctacagggatgcagaaaattgaaactttgttctatgctatggtgaccccactcttcaatccccttatctatagcctccagaataaggagataaaggcagccctgaggaaagttctgggaagttccaacataatctaaggcatattagattattcctccatgatcagatc

SEQ ID NO: 4191 - DNA, 1029 bp, Homo sapiens
tgcatgcctgtctcgtttccctctttctctctctctctctgatagtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatgattgcagggctc

SEQ ID NO: 4192 - DNA, 930 bp, Homo sapiens
atgagggaaaataaccagtcctctacactggaattcatcctcctgggagttactggtcagcaggaacaggaagatttcttctacatcctcttcttgttcatttaccccatcacattgattggaaacctgctcatcgtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccgcccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaa

SEQ ID NO: 4193 - DNA, 930 bp, Homo sapiens
atgaagaaagaaaatcaatcctttaacctggattttattctcctgggagttactagtcagcaagaacagaataatgtcttctttgtgatttttttgtgcatttaccccatcacactgactggaaatctgctcatcatcttggccatctgtgctgacattcgccttcacaaccccatgtattttctccttgccaacctctccttggttgacatcatcttctcatccgtaaccatccctaaggtgctggccaaccatctcttggggagcaagttcatctcctttgggggatgcctaatgcagatgtatttcatgatagccttggccaaggcagacagctataccttggctgcaatggcatacgatcgagctgtggccatcagctgcccacttcattacacaacaattatgagtccacggtcttgtatcctgcttattgctgggtcttgggtgattggaaacaccagtgctctcccccacactctgctcacagctagtttgtccttctgtggcaaccaggaagtagccaatttctactgtgacattatgcctttgctgaagttgtcctgttctgacgtccactttaatgtgaagatgatgtacctaggggtcggcgttttctctttgccattactatgcatcattgtctcctatgttcaggtcttttccacagtcttccaagttccatctaccaagagtctattcaaagccttctgcacctgtggctcccacctcacagttgtttttttatattatggtacaacgatgggcatgtatttccgccctctgaccagttacagccccaaagatgcagtgataactgtgatgtatgtggcagtgaccccagcattaaatcctttcatctatagtctgagaaattgggatatgaaggcagccctacagaaactcttcagcaagagaatctcctcatag

SEQ ID NO: 4194 - DNA, 995 bp, Homo sapiens
tgacttaaactgtctttcaggcaggctgactgtcactcatgatgagctttgcccctaatgcttcacactctccggtttttttgctccttgggttctcgagagctaacatctcctacactctcctcttcttcctgttcctggctatttacctgaccaccatactggggaatgtgacactggtgctgctcatctcctgggactccagactgcactcacccatgtattatctgcttcgtggcctctctgtgatagacatggggctatccacagttacactgccccagttgctggcccatttggtctctcattacccaaccattcctgctgcccgctgcttggctcagttctttttcttctatgcatttggggttacagatacacttgtcattgctgtcatggctctggatcgctatgtggccatctgtgaccccctgcactatgctttggtaatgaatcaccaacggtgtgcctgcttactagccttgagctgggtggtgtccatactgcacaccatgttgcgtgtgggactcgtcctgcctctttgctggactggggatgctgggggcaacgttaaccttcctcacttcttttgtgaccaccggccacttctgcgagcctcttgttctgacatacattctaatgagctggccatattctttgagggtggcttccttatgctgggcccctgtgccctcattgtactctcttatgtccgaattggggccgctattctacgtttgccttcagctgctggtcgccgccgagcagtctccacctgtggatcccacctcaccatggttggtttcctctacggcaccatcatttgtgtctacttccagcctcccttccagaactctcagtatcaggacatggtggcttcagtaatgtatactgccattacacctttggccaacccatttgtgtatagcctccacaataaggatgtcaagggtgcactctgcaggctgcttgaatgggtgaaggtagacccctga

SEQ ID NO: 4195 - DNA, 1307 bp, Homo sapiens
tttgcattttcttttgggggaagaagtcagtcttgaaagaagttgatactgacatgtccagcatgtctatgtgactatgaagacagaatatcatgaacacaagatgtcattggaaagcattcaagcaagcaagtttggatgctacttacctgcgcacgcatgcacacacacacacacacacacacacacacactgtctctctctcatgaataagagacttaacactgctggcttttacaatttaataacttatttttctagatttgttgggaatatggaaaaaagaaatctaacagttgtcagggaattcgtccttctgggacttcctagctcagcagagcagcagcacctcctgtctgtgctctttctctgtatgtatttagccaccaccttggggaacatgctcatcattgcgacgattggctttgactctcacctccattcccctatgtacttcttccttagtaacttggcctttgttgacatctgctttacgtcgactacagtcccccaaatggtagtgaatatcttgactggcaccaagactatctcttttgcaggctgcctcacccagctcttcttcttcgtttcttttgtgaatatggacagcctccttctgtgtgtgatggcgtatgatagatatgtggcgatttgccaccccttacattacaccgccagaatgaacctgtgcctttgtgtccagctagtggctggactgtggcttgttacttacctccacgccctcctgcatactgtcctaatagcacagctgtccttctgtgcctccaatatcatccatcatttcttctgtgatctcaatcctctcctgcagctctcttgctctgacgtctccttcaatgtaatgatcatttttgcagtaggaggtctattggctctcacgccccttgtctgtatcctcgtatcttatggacttatcttctccactgttctgaagatcacctctactcagggcaagcagagagctgtttccacctgcagctgccacctgtcagtggtggtgttgttttacggcacagccatcgccgtctatttcagcccttcatccccccatatgcctgagagcgacactctgtcaaccatcatgtattcaatggtggctccgatgctgaatcctttcatctataccctaaggaacagggatatgaagaggggacttcagaaaatgcttctcaagtgcacagtctttcagcagcaataatgacctcagtgactgaattaaataatactaatgtggtgataagaaagtgtgactagatgctcacaataacagtgagaagagaaaccaa

SEQ ID NO: 4196 - DNA, 1307 bp, Homo sapiens
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctatgtatttgtttctcagcaacttgtccttctctgacctctgcttctcttccgtgaccattcccaagttgttacagaacatgcagaaccaggacccatccatcccctatgcggactgcctgacccaaatgtacttcttcctgttatttggagacctggagagcttcctccttgtggccatggcctatgaccgctatgtggccatctgcttccccctgcactacaccgccatcatgagccccatgctctgtctcgccctggtggcgctgtcctgggtgctgaccaccttccatgccatgttacacactttactcatggccaggttgtgtttttgtgcagacaatgtgatcccccactttttctgtgatatgtctgctctgctgaagctggccttctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctgtctgtggtgtcactgttctatggaaccgttattggtctctacttatgctcatcagctaatagttctactctaaaggacactgtcatggctatgatgtacactgtggtgacccccatgctgaaccccttcatctacagcctgaggaacagagacatgaagggagccctgagcagagtcattcatcagaagaaaactttcttctctctctgatgataacacttggagctattacatagtttatccagtaaaatattgatattaatattggaatattattctaaattatttcctcaccatccttttgttgaaatggcatcgtacataatttttcaatatgtagtggagatgaagcatagctgagtagttgaactagggaagagggtcttggtgacctggctaagacttcctgtttgtcttcccaaggtgatcttggaaaaatgtagtttaagaacaactgttttaaatggtcttcatgccccacattcttaaattatcacaggattttgttatgttactcagaattttgctttgattgtagaatcatttttgtttaattaaaaaaatttttaaat

SEQ ID NO: 4197 - DNA, 972 bp, Homo sapiens
atgatgggacaaaatcaaaccagcatctcagacttcctgctcctgggcctgcccatccaaccagagcagcaaaacctgtgctatgccctgttcttggccatgtatcttaccaccctcctggggaacctcctcatcattgtcctcattcgactggactcccatctccacacgcctgtgtatttgtttctcagcaacttgtccttctctgacctctgcttttcctcagtcacaatgcccaaattgctgcagaacatgcagaaccaagacccatccatcccctatgcagactgcctgacccaaatgtacttcttcttgtatttttcggatctagagagcttcctccttgtggccatggcctatgaccgctatgtggccatctgcttccccatgcactacaccgccatctgcttcctcctgcactacaccgccatcatgagccccatgctctgtctctccgtggtggcgctgtcctgggtgctgaccaccttccatgccatgttacacactttactcatggccaggttgtgtttttgtgcagacaatgtgatcccccactttttctgtgatatgtctgctctgctgaagctggcctgctctgacactcgagttaatgaatgggtgatatttatcatgggagggctcattcttgtcatcccattcctactcatccttgggtcctatgcaagaattgtctcctccatcctcaaggtcccttcttctaagggtatctgcaaggccttctctacttgtggctcccacctctctgtggtgtcactgttctatgggaccgttattggtctctacttatgcccatcagctaatagttctactctaaaggacactgtcatggctatgatgtacactgtggtgacccctatgctgacccccttcatctacagcctgaggaacagagacatgaagggagccctggaaagggtcatttgtaaaaggaaaaatcccttccttctatga

SEQ ID NO: 4198 - DNA, 998 bp, Homo sapiens
caattaacccaactttcttcctacagacaaatggaggggaaaaatctgaccagcatctcagaatgtttcctcctggggttctctgagcagctggaggagcagaagcccctctttgggtccttcctgttcatgtacttggtcacggtggcaggcaacctcctcatcattctagtcatcattactgacactcaactccatacccccatgtacttctttctagccaacctctcccttgcagatgcctgctttgtgtccaccacagtccctaagatgctggcaaacatacagatccagagtcaggccatctcctactcagggtgtctactacagttgtattttttcatgttatttgtgatgctggaggcattcctcttggcggtcatggcctatgactgctacgtggccatatgccacccacttcattacattctgatcatgagccctgggctctgcatcttcctcgtgtctgcatcctggatcatgaatgccctccactcccttctacacacacttctgatgaacagcctgtccttctgcgcaaaccatgagatcccacacttcttctgtgacatcaatcccctcctgagtctgtcctgcacagaccccttcaccaatgagctggtgatcttcatcactgggggtctcacaggactcatttgtgtgctttgcctgattatctcttacacgaacgttttctcgaccatcctgaagatcccatcagctcaggggaagcggaaagccttttccacctgcagctctcatctctccgtggtctctctcttctttgggacttctttttgtgttgatttcagttctccctcaacccactcggcccagaaggacacagttgcatcagtgatgtacacagtggtaactccaatgttgaatccctttatctacagtttgaggaaccaagaaataaagtcttccctgagaaagttaatctgggttcggaaaattcattccccttagtggtagtgacttgacatccaatatgg

SEQ ID NO: 4199 - DNA, 1242 bp, Homo sapiens
gggaagctgggaccagaatggcatctctgacacctggctctgtgtggtttttctccctttttgttcccactagtcacagaccatacatggaaccagaaaagcaaaccgaaatctcagaattcttcctccagggactctcagaaaagccagagcatcagaccctcctcttcacaatgttcctctccacatacctggtcaccatcattggaaatgccctcattatcctggccatcatcacggactctcacctccacacacccatgtacttctttctcttcaacctctcactcgttgacaccctattatcctccaccaccgtccccaagatgctagcgaacatccaggctcagagcagagccatcccctttgtgggctgcctcacccagatgtatgccttccacctgttcgggaccatggacagctttctcctggcagtaatggccatcgaccgcttcgtggccattgtccacccacagcgttacttggttctcatgtgctcccctgtctgtgggctgctgctgggagcatcatggatgatcaccaacctccagtctctcatacacacctgcctcatggctcaactgaccttctgcgccggctctgaaatctcccacttcttctgtgacctcatgcccctgctgaagctctccggctcagacacgcacaccaacgagctggtgatctttgcttttggcattgtcgtgggcaccagcccattctcctgcatccttctctcgtacatccgcattttctggacagtctttaagatcccttctactcggggcaagtggaaagccttctccacctgtggcttacacctcactgtggtgtcactgtcctatgggaccatctttgctgtgtacttacagcccacatcccccagctcctcccagaaggacaaggcagccgccctaatgtgtggggtgttcatccccatgctcaacccctttatctacagcatacggaacaaggatatgaaggcagccctggggaagctcatcggcaaagtggccgtcccctgtcctaggccagaacagttattggatgtttatcatgttccaggatcactgttggctgctagggacacagagatgcatcccatcccctaccctggaggagttcagagtctagctgggaacagagacatggaataaatccttccagtacaacgtgataaatgtgtcataaagagatgaacaaagtgtatgagcacccaaaggaaaggtgtgcattttccccagg

SEQ ID NO: 4200 - DNA, 1016 bp, Homo sapiens
tttccctagtgccctccagctgatataaacatgagccctgagaaccagagcagcgtgtccgagttcctcctcctgggcctccccatccggccagagcagcaggccgtgttcttcgccctgttcctgggcatgtacctgaccacggtgctggggaacctgctcatcatgctgctcatccagctagactctcaccttcacacccccatgtacttcttccttagccacttggccctcactgacatctccttttcatctgtcactgtccctaagatgctgatgaacatgcagactcagcacctagccgtcttttacaagggatgcatttcacagacatattttttcatattttttgctgacttagacagtttccttatcacttcaatggcatatgacaggtatgtggccatctgtcatcctctacattatgccaccatcatgactcagagccagtgtgtcatgctggtggctgggtcctgggtcatcgcttgtgcgtgtgctcttttgcataccctcctcctggcccagctttccttctgtgctgaccacatcatccctcactacttctgtgaccttggtgccctgctcaagttgtcctgctcagacacctccctcaatcagttagcaatctttacagcagcattgacagccattatgcttccattcctgtgcatcctggtttcttatggtcacattggggtcaccatcctccagattccctctaccaagggcatatgcaaagccttgtccacttgtggatcccacctctcagtggtgactatctattatcggacaattattggtctctattttcttcccccatccagcaacaccaatgacaagaacataattgcttcagtgatatacacagcagtcactcccatgttgaacccattcatttacagtctgagaaataaagacattaagggagccctaagaaaactcttgagtaggtcaggcgcagtggctcatgcctgtaatctcaacactttgggaggctgaggcagacggatcacctg

SEQ ID NO: 4201 - DNA, 942 bp, Homo sapiens
atgagccctgagaaccagagcagcgtgtccgagttcctccttctgggcctccccatccggccagagcagcaggctgtgttcttcaccctgttcctgggcatgtacctgaccacggtgctggggaacctgctcatcatgctgctcatccagctggactctcaccttcacacccccatgtacttcttcctcagccacttggctctcactgacatctccttttcatctgtcactgtccctaagatgctgatggacatgcggactaagtacaaatcgatcctctatgaggaatgcatttctcagatgtatttttttatattttttactgacctggacagcttccttattacatcaatggcatatgaccgatatgttgccatatgtcaccctctccactacactgtcatcatgagggaagagctctgtgtcttcttagtggctgtatcttggattctgtcttgtgccagctccctctctcacacccttctcctgacccggctgtctttctgtgctgcgaacaccatcccccatgtcttctgtgaccttgctgccctgctcaagctgtcctgctcagatatcttcctcaatgagctggtcatgttcacagtaggggtggtggtcattaccctgccattcatgtgtatcctggtatcatatggctacattggggccaccatcctgagggtcccttcaaccaaagggatccacaaagcattgtccacatgtggctcccatctctctgtggtgtctctctattatgggtcaatatttggccagtaccttttcccgactgtaagcagttctattgacaaggatgtcattgtggctctcatgtacacggtggtcacacccatgttgaacccctttatctacagccttaggaacagggacatgaaagaggcccttgggaaactcttcagtagagcaacatttttctcttggtga

SEQ ID NO: 4202 - DNA, 939 bp, Homo sapiens
atgagccctgagaaccagagcagcgtgtccgagttcctccttctgggcctccccatccggccagagcagcaggctgtgttcttcaccctgttcctgggcatgtacctgaccacggtgctggggaacctgctcatcatgctgctcatccagctggactctcaccttcacacccccatgtacttcttcctcagccacttggctctcactgacatctccttttcatctgtcactgtccctaagatgctgatggacatgcggactaagtacaaatcgatcctctatgaggaatgcatttctcagatgtatttttttatattttttactgacctggacagcttccttattacatcaatggcatatgaccgatatgttgccatatgtcaccctctccactacactgtcatcatgagggaagagctctgtgtcttcttagtggctgtatcttggattctgtcttgtgccagctccctctctcacacccttctcctgacccggctcatgaagagggagaatcagagcagtgtgtctgagttcctcctcctggacctccccatctggccagagcagcaggctgtgttcttcaccctgttcttgggcatgtacctgatcacggtgctggggaacctgctcatcatcctgctcatccggctggactctcaccttcacacccccatgttcttcttcctcagccacttggctctcactgacatctccctttcatctgtcactgtcccaaagatgttattaagcatgcaaactcaggatcaatccattctttatgcagggtgtgtaactcagatgtattttttcatatttttcactgatctagacaatttccttctcacttcaatggcatacgatcggtatgtggccatctgtcaccccctccgctacaccactatcatgaaagagggactgtgtaacttactagtcactgtg

SEQ ID NO: 4203 - DNA, 942 bp, Homo sapiens
atgaagagggagaatcagagcagtgtgtctgagttcctcctcctggacctccccatctggccagagcagcaggctgtgttcttcaccctgttcttgggcatgtacctgatcacggtgctggggaacctgctcatcatcctgctcatccggctggactctcaccttcacacccccatgttcttcttcctcagccacttggctctcactgacatctccctttcatctgtcactgtcccaaagatgttattaagcatgcaaactcaggatcaatccattctttatgcagggtgtgtaactcagatgtattttttcatatttttcactgatctagacaatttccttctcacttcaatggcatacgatcggtatgtggccatctgtcaccccctccgctacaccactatcatgaaagagggactgtgtaacttactagtcactgtgtcctggatcctctcctgtaccaatgccctgtctcacactctcctcctggcccagctgtccttttgtgctgacaacaccatcccccatttcttctgtgatcttgttgccctactcaagctctcatgctcagacatctccctcaatgagctggtcattttcacagtgggacaggcagtcattactctaccactaatatgcatcttgatctcttatggccacattggggtcaccatcctcaaggctccatctactaagggcatcttcaaagctttgtccacctgtggctctcacctctctgtggtgtctctgtattatggcacaattattggactgtattttctcccctcatccagtgcctccagtgacaaggacgtaattgcctctgtgatgtacacggtgatcaccccattgctgaatcccttcatttatagcctaaggaacagggacataaagggagccctggagagactcttcaacagggcaacagtcttatctcaatga

SEQ ID NO: 4204 - DNA, 1026 bp, Homo sapiens
ccttcaggttccaggcgaataaccagcctgccatggaggctgccaatgagtcttcagagggaatctcattcgttttattgggactgacaacaagtcctggacagcagcggcctctctttgtgctgttcttgctcttgtatgtggccagcctcctgggtaatggactcattgtggctgccatccaggccagtccagcccttcatgcacccatgtacttcctgctggcccacctgtcctttgctgacctctgcttcgcctccgtcactgtgcccaagatgttggccaacttgttggcccatgaccactccatctcgctggctggctgcctgacccaaatgtacttcttctttgccctgggggtaactgatagctgtcttctggcggccatggcctatgactgctacgtggccatccggcaccccctcccctatgccacgaggatgtcccgggccatgtgcgcagccctggtgggaatggcatggctggtgtcccacgtccactccctcctgtatatcctgctcatggctcgcttgtccttctgtgcttcccaccaagtgccccacttcttctgtgaccaccagcctctcttaaggctctcgtgctctgacacccaccacatccagctgctcatcttcaccgagggcgccgcagtggtggtcactcccttcctgctcatcctcgcctcctatggggccatcgcagctgccgtgctccagctgccctcagcctctgggaggctccgggctgtgtccacctgtggctcccacctggctgtggtgagcctcttctatgggacagtcattgcagtctacttccaggccacatcccgacgcgaggcagagtggggccgtgtggccactgtcatgtacactgtagtcacccccatgctgaaccccatcatctacagcctctggaatcgcgatgtacagggggcactccgagcccttctcattgggcgaaggatctcagctagtgactcctgagggcaggaccccactgaggacagactgcatcacccacactggc

SEQ ID NO: 4205 - DNA, 933 bp, Homo sapiens
atgggaagaaataacctaacaagaccctctgaattcatcctccttggactctcctctcgacctgaggatcagaagccgctctttgctgtgttcctccccatctaccttatcacagtgataggaaacctgcttatcatcctggccatccgctcagacactcgtctccagacgcccatgtacttctttctaagcatcctgtcttttgttgacatttgctatgtgacagtcattatccctaagatgctggtgaacttcttatcagagacaaagaccatctcttacagtgagtgtctgacccagatgtactttttcttagcctttggaaacacagacagttacctgctagcagccatggccattgaccgctatgtggccatatgtaatcccttccactacatcaccattatgagtcacagatgctgtgtcctgcttctggttctctccttctgcattccacattttcactccctcctgcacattcttctgactaatcagctcatcttctgtgcctcaaatgtcatccatcactttttctgcgatgatcaaccagtgctaaaattgtcctgttcctcccattttgtcaaagaaatcacagtaatgacagaaggcttggctgtcataatgaccccgttttcatgcatcatcatctcttatttaagaatcctcatcactgttctgaagattccttcagctgctggaaagcgtaaagcattttctacctgtggctctcatctcacagtggtgaccctgttttatggaagcattagctatctctattttcagcccctgtccaactatactgtcaaggatcaaatagcaacaattatctacaccgtactgactcctatgctaaatccatttatctatagtctgaggaacaaagacatgaagcagggtttggcaaagttgatgcacaggatgaaatgtcagtaa

SEQ ID NO: 4206 - DNA, 1083 bp, Homo sapiens
atggaaagaaaccacaatccagataattgtaatgttttaaattttttctttgctgataagaagaataaaaggagaaattttggacagattgtatcagatgttggaagaatctgttacagtgttagtttatctttaggtgaacccacaactatgggaagaaataacctaacaagaccctctgaattcatcctccttggactctcctctcgacctgaggatcagaagccgctctttgctgtgttcctccccatctaccttatcacagtgataggaaacctgcttatcatcctggccatccgctcagacactcgtctccagacgcccatgtacttctttctaagcatcctgtcttttgttgacatttgctatgtgacagtcattatccctaagatgctggtgaacttcttatcagagacaaagaccatctcttacagtgagtgtctgacccagatgtactttttcttagcctttggaaacacagacagttacctgctagcagccatggccattgaccgctatgtggccatatgtaatcccttccactacatcaccattatgagtcacagatgctgtgtcctgcttctggttctctccttctgcattccacattttcactccctcctgcacattcttctgactaatcagctcatcttctgtgcctcaaatgtcatccatcactttttctgcgatgatcaaccagtgctaaaattgtcctgttcctcccattttgtcaaagaaatcacagtaatgacagaaggcttggctgtcataatgaccccgttttcatgcatcatcatctcttatttaagaatcctcatcactgttctgaagattccttcagctgctggaaagcgtaaagcattttctacctgtggctctcatctcacagtggtgaccctgttttatggaagcattagctatctctattttcagcccctgtccaactatactgtcaaggatcaaatagcaacaattatctacaccgtactgactcctatgctaaatccatttatctatagtctgaggaacaaagacatgaagcagggtttggcaaagttgatgcacaggatgaaatgtcagtaa

SEQ ID NO: 4207 - DNA, 1118 bp, Homo sapiens
tgtaagaacaacgtggaaagatgcatgttgtagatgacataagaattatgtcattaattgacagtgttgcttatctttaggtgagtacaagtccatgggaatgtccaacctgacaagactctctgaatttattctcttgggactctcctctcggtctgaagaccagaggccactctttgccctctttcttatcatatacctggtcactttgatgggaaatctgctcatcatcttggctatccactctgatcctcgacttcaaaaccctatgtattttttcctaagcatcttgtcctttgctgatatttgctacacaacagtcatagtcccaaagatgctcgtgaacttcttatcagagaaaaagaccatttcctatgctgaatgtctggcacagatgtatttcttcctggtttttggaaacatagatagttatctcctggcggctatggccatcaaccgctgtgtagccatttgtaacccattccattatgtcactgttatgaaccgcagatgctgtgtgttgctactagcattccccatcactttctcctatttccactctctcctacatgtcctcctggtgaatcggctcaccttttgtacatcaaatgttatccatcattttttttgtgatgtcaaccctgtgctgaaactgtcctgctcctccacctttgtcaatgaaattgtggccatgacagaagggctggcctctgtgatggctccatttgtctgtatcatcatctcttatctaagaattctcatcgctgttctcaagattccctcagcagctggaaaacacaaagccttctccacctgcagctcccatctcactgtggtgattctgttttatgggagtattagctatgtctatttgcagcctttgtccagctatactgtcaaggaccgaatagcaacaatcaactacactgtgttgacatcagtgttgaacccatttatctacagtttaagaaacaaagacatgaaacggggcttacagaaattgataaacaagattaagtctcaaatgagtaggttctctacaaagaccaataaaatctgtggaccctgattacaaggtgtgtgtgtgtgtgtgtgtgtgtgtgttagcacctgatgcc

SEQ ID NO: 4208 - DNA, 936 bp, Homo sapiens
atggagacaaagaattatagcagcagcacctcaggcttcatcctcctgggcctctcttccaaccctaagctgcagaaacctctctttgccatcttcctcatcatgtacctactcactgcggtggggaatgtgctcatcatcctggccatctactctgaccccaggctccacacccctatgtacttttttctcagcaacttgtctttcatggatatctgcttcacaacagtcatagtgcctaagatgctggtgaattttctatcagagacaaagattatctcttatgtgggctgcctgatccagatgtacttcttcatggcatttgggaacactgacagctacctgctggcctctatggccatcgaccggctggtggccatctgcaaccccttacactatgatgtggttatgaaaccatggcattgcctactcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtaccatcttctcctacctgcaaatcatcgtcactgtgctcagaatcccctctgcagccgggaagtggaaggccttctctacctgtggctcccacctcactgtagtggtcctgttctatgggagtgtcatctatgtctattttaggcctctgtccatgtactcagtgatgaagggccgggtagccacagttatgtacacagtagtgacacccatgctgaaccctttcatctacagcctgaggaacaaagatatgaaaaggggtttgaagaaattaagacacagaatttactcatag

SEQ ID NO: 4209 - DNA, 936 bp, Homo sapiens
atggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggtaa

SEQ ID NO: 4210 - DNA, 1044 bp, Homo sapiens
atgagctatttttacaggcttaagcttatgaaagaagctgtcttggtcaaactgccctttacatctctcccactgcttctccaaaccctatccaggaagtccagagacatggagataaagaactacagcagcagcacctcaggcttcatcctcctgggcctctcttccaaccctcagctgcagaaacctctctttgccatcttcctcatcatgtacctgctcgctgcggtggggaatgtgctcatcatcccggccatctactctgaccccaggctccacacccctatgtacttttttctcagcaacttgtctttcatggatatctgcttcacaacagtcatagtgcctaagatgctggtgaattttctatcagagacaaaggttatctcctatgtgggctgcctggcccagatgtacttctttatggcatttgggaacactgacagctacctgctggcctctatggccatcgaccggctggtggccatctgcaaccccttacactatgatgtggttatgaaaccacggcattgcctgctcatgctattgggttcttgcagcatctcccacctacattccctgttccgcgtgctacttatgtctcgcttgtctttctgtgcctctcacatcattaagcactttttctgtgacacccagcctgtgctaaagctctcctgctctgacacatcctccagccagatggtggtgatgactgagaccttagctgtcattgtgacccccttcctgtgtatcatcttctcctacctgcgaatcatggtcactgtgctcagaatcccctctgcagccgggaagtggaaggccttctctacctgtggctcccacctcactgcagtagcccttttctatgggagtattatttatgtctattttaggcccctgtccatgtactcagtggttagggaccgggtagccacagttatgtacacagtagtgacacccatgctgaaccctttcatctacagcctgaggaacaaagatatgaagaggggtttgaagaaattacaggacagaatttaccggtaa

SEQ ID NO: 4211 - DNA, 1061 bp, Homo sapiens
ttgctaggttctcatgattggtgttatgaaatcagagcatgttaaatgacaaaacttcttgtttataactgagcccaagtcaatggaaagaatcaaccacaccagcagtgtctccgagtttatcctcctgggactctcctcccggcctgaggaccaaaagacactctttgttctcttcctcatcgtgtacctggtcaccataacagggaacctgctcatcatcctggccattcgcttcaacccccatcttcagacccctatgtatttcttcttgagttttctgtctctcactgatatttgctttacaacaagcgttgtccccaagatgctgatgaacttcctgtcagaaaagaagaccatctcctatgctgggtgtctgacacagatgtattttctctatgccttgggcaacagtgacagctgccttctggcagtcatggcctttgaccgctatgtggccgtctgtgaccctttccactatgtcaccaccatgagccaccaccactgtgtcctgctggtggccttctcctgctcatttcctcacctccactcactcctgcacacacttctgctgaatcgtctcaccttctgtgactccaatgttatccaccactttctctgtgacctcagccctgtgctgaaattgtcctgctcttccatatttgtcaatgaaattgtgcagatgacagaagcacctattgttttggtgactcgttttctctgcattgctttctcttatatacgaatcctcactacagttctcaagattccctctacttctgggaaacgcaaagccttctccacctgtggtttttacctcaccgtggtgacgctcttttatggaagcatcttctgtgtctatttacagcccccatccacctacgctgtcaaggaccacgtggcaacaattgtttacacagttttgtcatccatgctcaatccttttatctacagcctgagaaacaaagacctgaaacagggcctgaggaagcttatgagcaagagatcctaggaagcaccctcttgaaaaactcgtaagtggaatctgctcaacttggacg

SEQ ID NO: 4212 - DNA, 1035 bp, Homo sapiens
ttccaaaaccatctccctgtcattcctataacctcccctttccatacttccagaggaatcacacccatggaaccaagaaaccaaaccagtgcatctcaattcatcctcctgggactctcagaaaagccagagcaggagacgcttctcttttccctgttcttctgcatgtacctggtcatggtcgtggggaacctgctcatcatcctggccatcagcatagactcccacctccacacccccatgtacttcttcctggccaacctgtccctggttgatttctgtctggccaccaacaccatccctaagatgctggtgagccttcaaaccgggagcaaggccatctcttatccctgctgcctgatccagatgtacttcttccatttctttggcatcgtggacagcgtcataatcgccatgatggcttatgaccggttcgtggccatctgccacccattgcactacgccaagatcatgagcctacgcctctgtcgcctgctggtcggcgccctctgggcgttttcctgcttcatctcactcactcacatcctcctgatggcccgtctcgttttctgcggcagccatgaggtgcctcactacttctgcgacctcactcccatcctccgactttcgtgcacggacacctctgtgaataggatcttcatcctcattgtggcagggatggtgatagccacgccctttgtctgcatcctggcctcctatgctcgcatccttgtggccatcatgaaggtcccctctgcaggcggcaggaagaaagccttctccacctgcagctcccacctgtctgtggttgctctcttctatgggaccaccattggcgtctatctgtgtccctcctcggtcctcaccactgtgaaggagaaagcttctgcggtgatgtacacagcagtcacccccatgctgaatcccttcatctacagcttgaggaacagagacctgaaaggggctctcaggaagctggtcaacagaaagatcacctcatcttcctgaccaccaggactcaggaacttctggggg

SEQ ID NO: 4213 - DNA, 942 bp, Homo sapiens
atggaaccaagaaaccaaaccagtgcatctcaattcatcctcctgggactctcagaaaagccagagcaggagacgcttctcttttccctgttcttctgcatgtacctggtcatggtcgtggggaacctgctcatcatcctggccatcagcatagactcccacctccacacccccatgtacttcttcctggccaacctgtccctggttgatttctgtctggccaccaacaccatccctaagatgctggtgagccttcaaaccgggagcaaggccatctcttatccctgctgcctgatccagatgtacttcttccatttctttggcatcgtggacagcgtcataatcgccatgatggcttatgaccggttcgtggccatctgccacccattgcactacgccaagatcatgagcctacgcctctgtcgcctgctggtcggcgccctctgggcgttttcctgcttcatctcactcactcacatcctcctgatggcccgtctcgttttctgcggcagccatgaggtgcctcactacttctgcgacctcactcccatcctccgactttcgtgcacggacacctctgtgaataggatcttcatcctcattgtggcagggatggtgatagccacgccctttgtctgcatcctggcctcctatgctcgcatccttgtggccatcatgaaggtcccctctgcaggcggcaggaagaaagccttctccacctgcagctcccacctgtctgtggttgctctcttctatgggaccaccattggcgtctatctgtgtccctcctcggtcctcaccactgtgaaggagaaagcttctgcggtgatgtacacagcagtcacccccatgctgaatcccttcatctacagcttgaggaacagagacctgaaaggggctctcaggaagctggtcaacagaaagatcacctcatcttcctga

SEQ ID NO: 4214 - DNA, 936 bp, Homo sapiens
atggaaaaccaatccagcatttctgaatttttcctccgaggaatatcagcgcctccagagcaacagcagtccctcttcggaattttcctgtgtatgtatcttgtcaccttgactgggaacctgctcatcatcctggccattggctctgacctgcacctccacacccccatgtactttttcttggccaacctgtcttttgttgacatgggtttaacgtcctccacagttaccaagatgctggtgaatatacagactcggcatcacaccatctcctatacgggttgcctcacgcaaatgtatttctttctgatgtttggtgatctagacagcttcttcctggctgccatggcgtatgaccgctatgtggccatttgccaccccctctgctactccacagtcatgaggccccaagtctgtgccctaatgcttgcattgtgctgggtcctcaccaatatcgttgccctgactcacacgttcctcatggctcggttgtccttctgtgtgactggggaaattgctcactttttctgtgacatcactcctgtcctgaagctgtcatgttctgacacccacatcaacgagatgatggtttttgtcttgggaggcaccgtactcatcgtcccctttttatgcattgtcacctcctacatccacattgtgccagctatcctgagggtccgaacccgtggtggggtgggcaaggccttttccacctgcagttcccacctctgcgttgtttgtgtgttctatgggaccctcttcagtgcctacctgtgtcctccctccattgcctctgaagagaaggacattgcagcagctgcaatgtacaccatagtgactcccatgttgaacccctttatctatagcctaaggaacaaggacatgaagggggccctaaagaggctcttcagtcacaggagtattgtttcctcttag

SEQ ID NO: 4215 - DNA, 1103 bp, Homo sapiens
cagttctggccacacagatgcatatctgtaaattgatctaataaataaatactgacacatggaaggtttttatctgcgcagatcacacgaactacaagggatgggaaaaccaggcagagtgaaccaaaccactgtttcagacttcctccttctaggactctctgagtggccagaggagcagcctcttctgtttggcatcttccttggcatgtacctggtcaccatggtggggaacctgctcattatcctggccatcagctctgacccacacctccatactcccatgtacttctttctggccaacctgtcattaactgatgcctgtttcacttctgcctccatccccaaaatgctggccaacattcatacccagagtcagatcatctcgtattctgggtgtcttgcacagctatatttcctccttatgtttggtggccttgacaactgcctgctggctgtgatggcatatgaccgctatgtggccatctgccaaccactccattacagcacatctatgagtccccagctctgtgcactaatgctgggtgtgtgctgggtgctaaccaactgtcctgccctgatgcacacactgttgctgacccgcgtggctttctgtgcccagaaagccatccctcatttctattgtgatcctagtgctctcctgaagcttgcctgctcagatacccatgtaaacgagctgatgatcatcaccatgggcttgctgttcctcactgttcccctcctgctgatcgtcttctcctatgtccgcattttctgggctgtgtttgtcatctcatctcctggagggagatggaaggccttctctacctgtggttctcatctcacggtggttctgctcttctatgggtctcttatgggtgtgtatttacttcctccatcaacttactctacagagagggaaagtagggctgctgttctctatatggtgattattcccacgctaaacccattcatttatagcttgaggaacagagacatgaaggaggctttgggtaaactttttgtcagtggaaaaacattctttttatgattagacatctagacggtgatgtctaatcttgatcaacccctccctgtcttcc

SEQ ID NO: 4216 - DNA, 1079 bp, Homo sapiens
cactggggcacaacagtgactatatgtccaagtctatagaactaattctttttgttcttatggcaacagatggacaacagcaactggaccagtgtgtcccattttgttctcttgggcatttccacccacccagaagagcaaatcccactcttccttgttttctcactcatgtacgcaatcaatatttctggcaacttggccatcatcacactgattctctctgctccacgcctccacatccccatgtacatcttcctcagtaacttggccttgacagacatctgcttcacctccaccacggtccccaagatgctgcagattattttctcccctacaaaggtaatttcctacacaggctgtttagcccaaacttatttcttcatttgcttcgccgtcatggaaaacttcatcctggctgtgatggcctatgacaggtacattgccatctgccaccctttccactacactatgatcctgactagaatgctgtgtgtgaagatggtggtcatgtgccatgctctctcccaccttcatgccatgctgcatacctttctcataggccaactaatcttctgtgcagataacagaatcccccacttcttctgtgacctctacgctctgatgaagatctcctgcaccagcacctacctcaacacccttatgattcacacagaaggtgctgttgtaatcagtggagctctggccttcattactgcctcctatgcctgcatcatcctggtggtcctccggatcccctcagccaagggcaggtggaaaaccttttctacctgcggctcccacctcactgtggtggccatattctatggcaccctcagttgggtctacttccggcccctttccagctattcagtgaccaagggtcgcattataacagtcgtgtacacagtggtgactcccatgctgaaccccttcatctacagcctgaggaatggggatgtcaagggaggcttcatgaaatggatgagcagaatgcagacttttttctttagataaaaccccaaacacagttcagaggtttacctatggttctggagaaataatgttgtgcctcacagatc

SEQ ID NO: 4217 - DNA, 979 bp, Homo sapiens
atgaagacttttagttcctttcttcagatcggcagaaatatgcatcaaggaaaccaaaccaccatcactgaattcattctcctgggatttttcaagcaggatgagcatcaaaacctcctctttgtgcttttcttgggtatgtacctggtcactgtgattgggaacgggctcatcattgtggctatcagcttggatacgtaccttcatacccccatgtatctcttccttgccaatctatcctttgctgatatttcctccatttccaactcagtccccaaaatgctggtgaatattcaaaccaagagtcaatccatctcttatgagagctgcatcacacagatgtacttttctattgtgtttgtcgtcattgacaatttgctcttggggaccatggcctatgaccactttgtggcgatctgccaccctctgaattatacaattctcatgcggcccaggttcggcattttgctcacagtcatctcatggttcctcagtaatattattgctctgacacacacccttctgctcattcaattgctcttctgtaaccacaacactctcccacacttcttctgtgacttggcccctctgctcaaactgtcctgttcagatacattgatcaatgagcttgtgttgtttattgtgggtttatcagttatcatcttcccctttacactcagcttcttttcctatgtctgcatcatcagagctgtcctgagagtatcttccacacagggaaagtggaaagccttctccacttgtggctctcacctgacagttgtattactgttctacggaaccattgtaggcgtgtactttttcccctcctccactcaccctgaggacactgataagattggtgctgtcctattcactgtggtgacacccatgataaaccccttcatctacagcttgaggaataaggatatgaaaggtgccctgagaaagctcatcaatagaaaaatttcttccctttgat

SEQ ID NO: 4218 - DNA, 980 bp, Homo sapiens
atgaagactttgtgttcctttcttcagatcagcagaaatatgcatcaagaaaaccaaaccaccatcactgaattcattctcctgggactctccaaccaggctgaacatcaaaacctcctctttgtgcttttcctgagtatgtatgtggtcactgtggttgggaacgggctcatcattgtggctatcagcttggatatataccttcacacccccatgtatctcttccttgcctacctatcctttgctgatatttcctccatttccaactcagtccccaaaatgctggtgaatattcaaaccaacagccaatccatctcttatgagagctgcatcacacagatgtacttttctattgtgtttgtcgtcactgacaatttgcttttggggaccatggccttcgaccactttgtggcgatctgccaccctctgaactatacaactttcatgcgggccaggttcggcactttgctcacagtcatctcgtggttcctcagtaatattattgctcttacacacacccttctgctcattcaattgctcttctgtgaccacaacactctcccacacttcttctgtgacttggcccctctgctcaaactgtcctgttcagatacaatgatcaatgagcttgtgttgtttattgtgggtttatcagttatcatcttcccctttgtactcatcttcttctcctatgtctgcatcatcagagctgtcctgggagtatcatccacacagggaaagtggaaagccttctccacttgtggctctcacctgacaattgcattactgttctacggaaccactgtaggcgtgtactttttcccctcctccactcaccctgaggacactgataagattggtgctgtcctattcactgtggtgacacccatgatgaaccccttcatctacagcttgaggaataaggatatgaaaggtgccctgagaaagctcatcaatagaaaaatttcttccctttgatg

SEQ ID NO: 4219 - DNA, 1053 bp, Homo sapiens
ggggacttctgcccacacttatagctacaggaaactggacaagaataagtgagtttatcctcatgagcttctcttccctgcctactgaaatacagtcattactctttctgacatttctaaccatctacctggtcaccctgatgggaaactgcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggagtggctgaatgcttcctcctggctaccatggcatatgaccgctatgtggccatctgcagtcccttgcactacccagtcatcatgaaccaaaggactcgtgccaaactggctgctgcctcctggttcccaggctttcctgtagctactgtgcagaccacatggctcttcagttttccattctgtggcaccaacaaggtgaaccacttcttctgtgacagcccacctgtgctgaggctggtctgtgcagacacagcactctttgagatctacgccatcgtcggaaccattctggtggtcatgatcccctgcttgctgatcttgtgttcctatactcacattgctgctgccatcctcaagatcccatcagctaaagggaagaataaagccttttctacatgttcctcacacctccttgttgtctctcttttctatatatcattaagcctcacctacttccggcctaaatcaaataattcacctgagggcaagaagctgctatcattgtcctacactgttatgactcccatgttgaaccccattatctacagcctgagaaataacgaggtgaagaatgccctcagcaggacggtctctaaggccctagccctcagaaactgtatcccatagaccttaggaagtaaggctacattttactggatgagaaacaatcagtcccagatttgagattcctctctgcatctttcca

SEQ ID NO: 4220 - DNA, 1061 bp, Homo sapiens
tcacagctatgggattacgacttcatactcgatataccaggtccataaaaacaatataagtttcaactactgaaatgaaaagacaaaatcaaagctgtgtggttgaattcatcctcctgggcttttctaactttcctgagctccaggtgcagctctttggggttttcctagttatttatgtggtgaccctgatgggaaatgccatcattacagtcatcatctccttaaaccagagcctccacgttcccatgtacctgttcctcctgaacctatctgtggtggaggtgagtttcagtgcagtcattacgcctgaaatgctggtggtgctctctactgagaaaactatgatttcttttgtgggctgttttgcacagatgtatttcatccttctttttggtgggactgaatgttttctcctgggagcgatggcttatgaccgatttgctgcaatttgccatcctctgaactacccagtgattatgaacagaggggtttttatgaaattagtaatattctcatggatctcagggatcatggtggctactgtgcagaccacttgggtatttagttttccattttgtggccccaatgaaattaatcatctcttctgtgagactcccccggtactagagcttgtgtgtgcagacaccttcttatttgaaatctatgccttcacaggcaccattttgattgttatggttcctttcttgttgatcctcttgtcttacattcgagttctgtttgccatcctgaagatgccatcaactactgggagacaaaaggccttttccacctgtgcctctcacctcacatctgtgaccctgttctatggcacagccaatatgacttatttacaacccaaatctggctactcacccgaaaccaagaaactgatctcattggcttacacgttgcttacccctctgctcaatccgctcatctatagcttacgaaacagtgagatgaagaggactttgataaaactatggcgaagaaaagtgattttacacacattctgattgtgttgagaagctgagtaagatttggccactgcctgagtg

SEQ ID NO: 4221 - DNA, 995 bp, Homo sapiens
ccagtgaagtcctgggcagaagaatgatgtgggaaaactggacaattgtcagtgaatttgttctcgtgagcttctcagccctgtccactgagcttcaggctctactgtttctccttttcttgaccatttacttggttactttaatgggcaatgtcctcatcatcctggtcactatagctgactctgcactacaaagtcctatgtacttcttcctcagaaacttgtccttcctggagataggtttcaacttggtcattgtgcccaagatgctggggaccctgatcattcaagacacaaccatctccttccttggatgtgccactcagatgtatttcttcttcttttttggggctgctgagtgctgcctcctggccaccatggcatatgaccgctacgtggccatctgtgaccccttgcactacccagtcatcatgggccacatatcctgtgcccagctggcagctgcctcttggttctcagggttttcagtggccactgtgcaaaccacatggattttcagtttccctttttgtggccccaacagggtgaaccacttcttctgtgacagccctcctgttattgcactggtctgtgctgacacctctgtgtttgaactggaggctctgacagccactgtcctattcattctctttcctttcttgctgatcctgggatcctatgtccgcatcctctccactatcttcaggatgccgtcagctgaggggaaacatcaggcattctccacctgttccgcccacctcttggttgtctctctcttctatagcactgccatcctcacgtatttccgaccccaatccagtgcctcttctgagagcaagaagctgctgtcactctcttccacagtggtgactcccatgttgaaccccatcatctacagctcaaggaataaagaagtgaaggctgcactgaagcggcttatccacaggaccctgggctctcagaaactatgattggcttagatggaaactgaaggg

SEQ ID NO: 4222 - DNA, 1054 bp, Homo sapiens
ggaccacagctggggatttatgcccatacttatggctataggaaactggacagaaataagtgaatttatcctcatgagcttctcttccctacctactgaaatacagtcattgctcttcctgacatttctaactatctatttggttactctgaagggaaacagcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggggtagctgaatgcttcctcctggctaccatggcatatgaccgctatgtggccatctgcagtcccttgcactacccagtcatcatgaaccaaaggacacgggccaaactggctgctgcttcctggttcccaggctttcctgtagctactgtgcagaccacatggctcttcagttttccattctgtggcaccaacaaggtgaaccacttcttctgtgacagcccgcctgtgctgaagctggtctgtgcagacacagcactgtttgagatctacgccatcgtcggaaccattctggtggtcatgatcccctgcttgctgatcttgtgttcctatactcgcattgctgctgctatcctcaagatcccatcagctaaagggaagcataaagccttctctacgtgctcctcacacctccttgttgtctctcttttctatatatcttctagcctcacctacttctggcctaaatcaaataattctcctgagagcaagaagttgttatcattatcctacactgttgtgactcccatgttgaaccccattatctacagcttgagaaatagcgaggtgaagaatgccctcagcaggaccttccacaaggtcctagccctcagaaactgtatcccatagaccttaggaagtaaggctaaattctattgaatgacaattagtttcatgtttgggacacctctctgcctc

SEQ ID NO: 4223 - DNA, 1045 bp, Homo sapiens
ggaccacagctggggatttatgcccatacttatggctataggaaactggacagaaataagtgaatttatcctcatgagcttctcttccctacctactgaaatacagtcattgctcttcctgacatttctaactatctatttggttactctgaagggaaacagcctcatcattctggttaccctagctgaccccatgctacacagccccatgtacttcttcctcagaaacttatctttcctggagattggcttcaacctagtcattgtgcccaaaatgctggggaccctgcttgcccaggacacaaccatctccttccttggctgtgccactcagatgtatttcttcttcttctttggggtagctgaatgcttcctcctggctaccatggcatatgaccgctatgtggccatctgcagtcccttgcactacccagtcatcatgaaccaaaggacacgggccaaactggctgctgcttcctggttcccaggctttcctgtagctactgtgcagaccacatggctcttcagttttccattctgtggcaccaacaaggtgaaccacttcttctgtgacagcccgcctgtgctgaagctggtctgtgcagacacagcactgtttgagatctacgccatcgtcggaaccattctggtggtcatgatcccctgcttgctgatcttgtgttcctatactcgcattgctgctgctatcctcaagatcccatcagctaaagggaagcataaagccttctctacgtgctcctcacacctccttgttgtctctcttttctatatatcttctagcctcacctacttctggcctaaatcaaataattctcctgagagcaagaagttgttatcattatcctacactgttgtgactcccatgttgaaccccattatctacagcttgagaaatagcgaggtgaagaatgccctcagcaggaccttccacaaggtcctagccctcagaaactgtatcccatagaccttaggaagtaaggctaaattctattgaatgacaattagtttcatgtttgggacacct

SEQ ID NO: 4224 - DNA, 1030 bp, Homo sapiens
atggaaagacaaaatcaaagctgtgtggttgaattcatcctcttgggcttttctaactatcctgagctccaggggcagctctttgtggctttcctggttatttatctggtgaccctgataggaaatgccattattatagtcatcgtctccctagaccagagcctccacgttcccatgtacctgtttctcctgaacttatctgtggtggacctgagtttcagtgcagttattatgcctgaaatgctggtggtcctctctactgaaaaaactacaatttcttttgggggctgttttgcacagatgtatttcatccttctttttggtggggctgaatgttttcttctgggagcaatggcttatgaccgatttgctgcaatttgccatcctctcaactaccaaatgattatgaataaaggagtttttatgaaattaattatattttcatgggccttaggttttatgttaggtactgttcaaacatcatgggtatctagttttcccttttgtggccttaatgaaattaaccatatatcttgtgaaaccccagcagtgttagaacttgcatgtgcagacacgtttttgtttgaaatctatgcattcacaggcacctttttgattattttggttcctttcttgttgatactcttgtcttacattcgagttctgtttgccatcctgaagatgccatcaaccactgggagacaaaaggccttttccacctgtgccgctcacctcacatctgtgaccctattctatggcacagccagtatgacttatttacaacccaaatctggctactcaccggaaaccaagaaagtgatgtcattgtcttactcacttctgacaccactgctgaatctgcttatctacagtttgcgaaatagtgagatgaagagggctttgatgaaattatggcgaaggcgagtggttttacacacaatctgactgtgttgagaagccatgtaagatttagtcactgcatgactgtattcaatctaaatttaataaatttagattcattaagtttgca

SEQ ID NO: 4225 - DNA, 951 bp, Homo sapiens
atgatctgtgaaaatcacaccagagtcactgaatttattcttcttggttttacaaacaaccccgagatgcaagtttccctctttatttttttcctggccatttatacagtcactttgttgggcaactttcttattgtcacagttaccagtgtggatctcgcacttcaaacacccatgtacttctttcttcaaaatctgtcacttcttgaagtatgtttcaccttggttatggtgccaaaaatgcttgtagatctagtgtccccaaggaaaattatctcttttgtgggctgtggtacccagatgtacttcttcttcttctttggcagttctgaatgtttccttctctccatgatggcttatgatcgctttgtggccatctgtaaccctctccattattcagtcataatgaacaggtccctatgcttgtggatggccataggctcttggatgtccggtgttcctgtgtctatgctacagacagcttggatgatggcccttcctttctgtggaccaaatgccgtggaccactttttctgtgatggtcccccagtgttaaaactagtcacagtggatacaaccatgtatgaaatgcaagcacttgcctccacactcctgtttatcatgtttcccttttgtctcattttggtttcctacacccgcattatcataacaattctgaggatgtcctctgccactggccgccagaaggcattttctacttgttcctcacacctcattgtggtgtccctcttctacggaacagccagtctgacctacctgcggcccaaatcaaaccagtcccctgagagcaagaagctagtgtcattgtcctacactgtcatcacacctatgctaaaccccatcatctacggcctgaggaacaatgaagtgaaaggggctgtcaagaggacaatcactcaaaaagtcttacagaagttagatgtgttttga

SEQ ID NO: 4226 - DNA, 1020 bp, Homo sapiens
atggagaaaagagagataaacagtgcttttggggtaaaatccaggtataggtatttgggcccactctatgtcatctatacatattatcatattagaatcattcttctcttcactcaggctcctgaccttgacctctttccagctgcaaacgtgtccataatgggggccatcaagctcagccacaaccttcacactcctatgtactttttcctctgtggcctgtccttttcagaaacttgtaccactgtggtagtaatccctcgcatgttggtggactttctatcagagagcaagaccatttctcttcctgagtgtgccacacagatgtttttctttctgggctttgcatccaacaactgtttcatcatggccgctatgtcctacgaccgctacacggccatccacaacccactgcagtaccacacccttatgacaagaaagatctgcttgcagatgatgatggcttcttggatggttgggttcctgttttctctgtgcatcatcgtcactgtattcaacttgtctctttgcgacttgaacactatccagcactatttctgtgatatctcaccagtggtctcccttgcttgtaattacactttctatcatgaaatggctatttttgtgctctctgcctttgtgttggtgggcagctgtattttaattatgatttcctatgtcttcattgtgttcatagtcataaagatgccctctgcaaaggggaggtctaaggccttctcaacttgctcctcccacctcactgttgtgtccatacactatggatttgcttgctttgtctatttgaggcccaagaacagcaactccttcgatgaagacatgctgacggccatgatatatacaatactgatgcctctgcttaaccccatcgtgtacagtctgagaaacaaagaaatgcagatagccctaagaaaaacactaggcagtgtatttggggttttccctcagaagacaaaaaaagagcctgaacatttaaaaaaattacacagcattgataaataa

SEQ ID NO: 4227 - DNA, 1090 bp, Homo sapiens
aattgggcttctgggaccaagtgggtaccttctattaccccacagctatacccttgtgcttttcccatcatctttcctcctcaaacaggccccagatgctaaggaatggcagcatagtgacggaatttatcctcgtgggctttcagcagagctccacttccacacgagcattgctctttgccctcttcttggccctctacagcctcaccatggccatgaatggcctcatcatctttatcacctcctggacagaccccaagctcaacagccccatgtacttcttcctcggccatctgtctctcctggatgtctgcttcatcaccactaccatcccacagatgttgatccacctcgtggtcagggaccacattgtctcctttgtatgttgcatgacccagatgtactttgtcttctgtgttggtgtggccgagtgcatcctcttggctttcatggcctatgaccgttatgttgctatctgctacccacttaactatgtcccgatcataagccagaaggtctgtgtcaggcttgtgggaactgcctggttctttgggctgatcaatggcatctttctcgagtatatttcattccgagagcccttccgcagagacaaccacatagaaagcttcttctgtgaggcccccatagtgattggcctctcttgtggggaccctcagtttagtctgtgggcaatctttgccgatgccatcgtggtaattctcagccccatggtgctcactgtcacttcctatgtgcacatcctggccaccatcctcagcaaagcctcctcctcaggtcgggggaagactttctctacttgtgcctctcacctgactgtggtcatctttctctacacttcagctatgttctcttacatgaacccccacagcacacatgggcctgacaaagacaaacctttctccctcctgtacaccatcattacccccatgtgcaaccccatcatttatagtttccgcaacaaggaaattaaggaggccatggtgagggcacttggaagaaccaggctggcccagccacagtctgtctagcaggaaggccctgaaaggaaagctccttcacctggggaatg

SEQ ID NO: 4228 - DNA, 1016 bp, Homo sapiens
tctgcagatggagagcaaactaaaagagaaaaatcaaatgtgactacaataatggaatttgttcttttggggttttctgatattcccaatctccactggatgctttttagtatatttttacttatgtatttgatgatcctgatgtgcaatggcatcataatactactaataaaaattcaccccgctctccagactcccatgtatttttttcttagcaatttttcccttttggaaatctgttatgtaacaatcattatcccaagaatgctcatggacatttggactcagaaaggaaatatttctttgtttgcttgtgctacacaaatgtgtttttttcttatgcttggaggcacggagtgtctccttctgacagtgatggcctatgaccgctacgtggctatttgtaagcctttgcagtatcctctagtgatgaaccacaaagtctgcattcagctgataatagcttcctggaccatcacaattcctgtagtaattggggaaacatgccaaattttccttttgcccttttgcggaactaacacaattaatcatttcttttgtgacatcccgccaatactcaagcttgcttgtggaaacatatttgtgaatgagataacagtccatgtagtagcggtggtgtttatcacggtgccatttctgttgattgttgtctcttatggcaaaattatctccaacattttgaaattgtcatcagccagaggaaaggctaaagccttctccacctgctcatctcacctaatagttgtaatcttattctttggagcaggtactatcacttatttacagcccaaaccacatcagtttcaaaggatggggaaactgatttctcttttctacaccattctgattccaactttgaatcctattatatataccctgaggaacaaagatatcatggtggcattgagaaaattactagctaagttattaacatgagatgaagacttgaaattacagaaataatttctttataggtttgtcatgtggcttcagtg

SEQ ID NO: 4229 - DNA, 1649 bp, Homo sapiens
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcatggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 4230 - DNA, 1649 bp, Homo sapiens; identical to SEQ ID NO: 4229

SEQ ID NO: 4231 - DNA, 1649 bp, Homo sapiens
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacctcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatccagcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 4232 - DNA, 1649 bp, Homo sapiens
cagaaataagcaattaaggaagttcttgtcatcttttgcctgagcatgttttaaaactagagaaatgctcacccctctaaatagttgaactgtttaatgctataggagcttaaaaagagaggatctttctcattttttttctcctccttgaacactgtgaaatttatggtaaaatgacagaaaaagaagaaagactaagtgaatctggtaactaaagaaagagctggaaaaaagaaaactagagggcaagaggtgataagagaggtcacctcttatcagacaggagacaagttgatggagaaaaagatctgctatgagggaaaattctgtctccagccctgcaggaagaattggaaaatcagaaaagagtgaaaagggagctagactgacttaatcttcagcccaggtaaaactggaaagacagtttaacatgttctttagaatgataggcactatcaggaagagatgaagtcagggattcaggctcagagagacaaatactcatccaggatcccaagagtgagcaagggtggaatatggactccaggcaaggctgcctaatttcaaagtccatgatattctaatagaaagggagatctagtgctgcgatcagatgcagagagaggtcatctttgcccatttcacgattccatagttgtgatttttccttgccatttcttttgtcttccagtcaaaggtatgcaggcaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagagaaccatccagaaaacggtgcctatggagatttga

SEQ ID NO: 4233 - DNA, 1649 bp, Homo sapiens; identical to SEQ ID NO: 4229

SEQ ID NO: 4234 - DNA, 1649 bp, Homo sapiens; identical to SEQ ID NO: 4232

SEQ ID NO: 4235 - DNA, 1649 bp, Homo sapiens; identical to SEQ ID NO: 4232

SEQ ID NO: 4236 - DNA, 1649 bp, Homo sapiens; identical to SEQ ID NO: 4232

SEQ ID NO: 4237 - DNA, 885 bp, Homo sapiens
tcagtcactgaatttctccttttgggagtgacagacattcaagaactgcagccttttctcttcgttgttttccttaccatctacttcatcagtgtggctgggaatggagccattctgatgattgtcatctctgatcctagactccattcccctatgtatttcttcctgggaaacctgtcctgcctggacatctgctactccagcgtaacactgccaaaaatgctgcagaacttcctctctgcacacaaaatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcatggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagaga

SEQ ID NO: 4238 - DNA, 885 bp, Homo sapiens; identical to SEQ ID NO: 4237

SEQ ID NO: 4239 - DNA, 885 bp, Homo sapiens
tcagtcactgaatttctccttttgggagtgacagacattcaagaactgcagccttttctcttcgttgttttccttaccatctacttcatcagtgtggctgggaatggagccattctgatgattgtcatctctgatcctagactccattcccctatgtatttcttcctgggaaacctgtcctgcctggacatctgctactccagcgtaacactgccaaaaatgctgcagaacttcctctctgcacacaaaatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatccagcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagaga

SEQ ID NO: 4240 - DNA, 885 bp, Homo sapiens
tcagtcactgaatttctccttttgggagtgacagacattcaagaactgcagccttttctcttcgttgttttccttaccatctacttcatcagtgtggctgggaatggagccattctgatgattgtcatctctgatcctagactccattcccctatgtatttcttcctgggaaacctgtcctgcctggacatctgctactccagcgtaacactgccaaaaatgctgcagaacttcctctctgcacacaaaatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagaga

SEQ ID NO: 4241 - DNA, 912 bp, Homo sapiens
gagaggatgagtgcaaacacctccatggtgactgagtttcttcttctcggcttctcccacctggccgacctccagggcttgctcttctctgtctttctcactatctacctgctgaccgtggcaggcaatttcctcattgtggtgctggtctccactgatgctgccctccagtcccctatgtacttcttcctgcgcaccctctcggccttggagattggctatacgtctgtcacggtccccctgctacttcaccacctccttactggccggcgccacatctctcgctctggatgtgctctccagatgttcttcttcctcttctttggcgccacggagtgctgcctcctggcagccatggcctatgaccgctatgcagccatctgtgaacccctccgctacccactgctgctgagccaccgggtgtgtctacagctagctgggtcggcgtgggcctgtggggtgctggtggggctgggccacacccctttcatcttctctttgcccttctgcggccccaataccatcccgcagttcttctgtgagatccagcctgtcctgcagctggtatgtggagacacctcgcttaatgaactgcagattatcctggcaacagccctcctcatcctctgcccctttggcctcatcctgggctcctacgggcgtatcctcgttaccatcttccggatcccatctgttgcgggccgccgcaaggccttctccacctgctcctcccacctgatcgtggtctccctcttctatggcaccgcactctttatctatattcgccctaaggccagctacgatccggccactgaccctctggtgtccctcttctatgctgtggtcacccccatcctcaaccccatcatctacagcctgcggaacacagaggtcaaagctgccctaaagaga

SEQ ID NO: 4242 - DNA, 885 bp, Homo sapiens; identical to SEQ ID NO: 4240

SEQ ID NO: 4243 - DNA, 885 bp, Homo sapiens; identical to SEQ ID NO: 4240

SEQ ID NO: 4244 - DNA, 1030 bp, Homo sapiens
caaggcattcttccatgtcctcagcctcctctttccttcctaggactggcttccatggaggtgaagaactgctgcatggtgacagagttcatccttttgggaatcccacacacagaggggctggagatgacactttttgtcttattcttgcccttctatgcctgcactctactgggaaatgtgtctatccttgttgctgttatgtcttctgctcgccttcacacacctatgtatttcttcctgggaaacttgtctgtgtttgacatgggtttctcctcagtgacttgtcccaaaatgctgctctaccttatggggctgagccgactcatctcctacaaagactgtgtctgccagcttttcttcttccatttcctcgggagcattgagtgcttcttgtttacggtgatggcctatgaccgcttcactgccatctgttatcctctgcgatacacagtcatcatgaacccaaggatctgtgtggccctggctgtgggcacatggctgttagggtgcattcattccagtatcttgacctccctcaccttcaccttgccatactgtggtcccaatgaagtggatcacttcttctgtgacattccagcactgttgcccttggcctgtgctgacacatccttagcccagagggtgagcttcaccaacgttggcctcatatctcttgtctgctttctgctaattcttttatcctacactagaatcacaatatctatcttaagcattcgtacaactgagggccgtcgccgtgccttctccacctgcagtgctcacctcattgccatcctctgtgcctatgggcccatcatcactgtctacctgcagcccacacccaaccccatgctgggaaccgtggtacaaattctcatgaatctggtaggaccaatgctgaaccctttgatctataccttgaggaataaggaagtaaaaacagccctgaaaacaatattgcacaggacaggccatgttcctgagagttagtaagagcagataaatgggtgcatggctctggaattcc

SEQ ID NO: 4245 - DNA, 1105 bp, Homo sapiens
ggcatcaatcatccgacaaaagcattcacttacaacatcattgtgctgtgtttctcttgtcaaacgtcaccattcatcttagcagactacaaaaagacatgggaaagaccaaaaacacatcgctggatgccgtggtgacagatttcattcttctgggtttgtctcaccccccaaatctaagaagcctcctcttcctggtcttcttcatcatttacatcctcactcagctggggaacctgctcattctgctcaccatgtgggctgacccgaagctctgtgctcgccccatgtacattcttctgggagtgctctcattcctggacatgtggctctcctcagtcaccgttcctcggcttattttggattttactccttccatcaaggctatcccgtttggtggctgtgtggctcaactgtatttctttcacttcctgggcagcacccagtgcttcctctacaccttgatggcctatgacaggtacctagcaatatgtcagcccctgcactacccagtgctcatgaatgggaggttatgcacagtccttgtggctggagcttgggtcgccggctccatgcatgggtctatccaggccaccttgaccttccgcctgccctactgtgggcccaatcaggtggattactttatctgtgacatccgcgcagtattgagactggcctgtgctgacacaactgtcaatgagcttgtgacctttgtggacgtcagggtagtggccgccagttgcttcatgttaattctgctctcctatgccaacatagtccatgccatcctgaagatacgcaccgctgatgggaggcgccgggccttctccacctgtggctcccacctaatcgtggtcacagtctactatgtcccctgtattttcatctaccttagggctggctccaaagaccccctggatggggcagcggctgtgttttacactgttgtcactccattactgaaccccctcatctatacactgaggaaccaggaagtgaagtctgccctgaagaggataacagcaggttgaaggactgaatgaaaataagtaactacatctgcatcattatcactgccactctcttcagctactgctgcatgtga

SEQ ID NO: 4246 - DNA, 942 bp, Homo sapiens
atggaaagaatcaacagcacactgttgactgcgtttatcctgacaggaattccgtatccactcaggctaaggacactcttttttgtgttcttttttctaatctacatcctgactcagctgggaaacctgcttattttaatcactgtctgggcagacccaaggctccatgcccgccccatgtacatctttcttggtgttctctcagtcattgatatgagcatctcctccatcattgtccctcgcctcatgatgaacttcactttaggtgtcaaacccatcccatttggtggctgtgttgctcaactctatttctatcacttcctgggcagcacccagtgcttcctctacaccctaatggcctatgacaggtacctggcaatatgtcagcccctgcgctaccctgtgctcatgactgctaagctgagcgccttgcttgtggctggagcctggatggcaggatccatccatggggctctccaggccatcctaaccttccgcctgccctactgtgggcccaatcaggtggattacttcttctgtgacatccctgcagtgttgagactggcctgtgctgacacaacagtcaacgagctggtgacgtttgtagacattggggtggtggttgccagttgcttctccctgatcctcctctcctacatacagatcattcaggccatcctgagaatccacacagctgatgggcggcgccgggctttttcaacttgtggagcccatgtaaccgtggtcaccgtgtactatgtgccctgtgccttcatctacctgaggcctgaaaccaacagccccctggatggggcagctgccctagtccccacggccatcactcctttcctcaacccccttatctacactctgcggaaccaagaggtgaagctggccctgaaaagaatgctcagaagcccaagaactccgagtgaggtttga

SEQ ID NO: 4247 - DNA, 936 bp, Homo sapiens
atgtccaacgccagcctcgtgacagcattcatcctcacaggccttccccatgccccagggctggacgccctcctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcaggtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgtgatggtcatctttgtggacattgggatagtggcctcaggctgctttgtcctgatagtgctgtcctatgtgtccatcgtctgttccatcctgcggatccgcacctcagatgggaggcgcagagcctttcagacctgtgcctcccactgtattgtggtcctttgcttctttgttccctgtgttgtcatttatctgaggccaggctccatggatgccatggatggagttgtggccattttctacactgtgctgacgccccttctcaaccctgttgtgtacaccctgagaaacaaggaggtgaagaaagctgtgttgaaacttagagacaaagtagcacatcctcagaggaaataa

SEQ ID NO: 4248 - DNA, 945 bp, Homo sapiens
tgagaagaaatgtccaacgccaccctactgacagcgttcatcctcacgggccttccccatgccccagggctggacgcccccctctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcaggactatctccttccacagctgcgtggctcagctctattttttccacttcctggggagcaccgagtgtttcctctacacagtcatgtcctatgatcgctacctggccatcagttacccgctcaggtacaccaacatgatgactgggcgctcgtgtgccctcctggccaccggcacttggctcagtggctctctgcactctgctgtccagaccatattgactttccatttgccctactgtggacccaaccagatccagcactacttctgtgacgcaccgcccatcctgaaactggcctgtgcagacacctcagccaacgagatggtcatctttgtgaatattgggctagtggcctcgggctgctttgtcctgatagtgctgtcctatgtgtccatcgtctgttccatcctgcggatccgcacctcagaggggaggcacagagcctttcagacctgtgcctcccactgtatcgtggtcctttgcttctttggccctggtcttttcatttacctgaggccaggctccagggacgccttgcatggggttgtggccgttttctacaccacgctgactcctcttttcaaccctgttgtgtacaccctgagaaacaaggaggtaaagaaagctctgttgaagctgaaaaatgggtcagtatttgctcagggtgaatag

SEQ ID NO: 4249 - DNA, 1045 bp, Homo sapiens
tcccagagggagagagaccaagggtgagaagaaatgtccaacgccagcctactgacagcgttcatcctcatgggccttccccatgccccagcgctggacgcccccctctttggagtcttcctggtggtttacgtgctcactgtgctggggaacctcctcatcctgctggtgatcagggtggattctcacctccacaccaccatgtactacttcctcaccaacctgtcgttcattgacatgtggttctccactgtcacggtgcccaaattgctgatgactttggtgttcccaagtggcagggctatctccttccacagctgcatggctcagctctatttctttcacttcctagggggcaccgagtgtttcctctacagggtcatgtcctgtgatcgctacctggccatcagttacccgctcaggtacaccagcatgatgactgggcgctcgtgtactcttctggccaccagcacttggctcagtggctctctgcactctgctgtccaggccatattgactttccatttgccctactgtggacccaactggatccagcactatttgtgtgatgcaccgcccatcctgaaactggcctgtgcagacacctcagccatagagactgtcatttttgtgactgttggaatagtggcctcgggctgctttgtcctgatagtgctgtcctatgtgtccatcgtctgttccatcctgcggatccgcacctcagaggggaagcacagagcctttcagacctgtgcctcccactgtatcgtggtcctttgcttctttggccctggtcttttcatttacctgaggccaggctccaggaaagctgtggatggagttgtggccgttttctacactgtgctgacgccccttctcaaccctgttgtgtacaccctgaggaacaaggaggtgaagaaagctctgttgaagctgaaagacaaagtagcacattctcagagcaaatagacactagggaagattacatatcttagctcttgtgaatagtgctgtgaaaaacatacaggggcaggtatcttttgga

SEQ ID NO: 4250 - DNA, 936 bp, Homo sapiens
atgtccaagaccagcctcgtgacagcgttcatcctcacgggccttccccatgccccagggctggacgccccactctttggaatcttcctggtggtttacgtgctcactgtgctggggaacctcctcatcctgctggtgatcagggtggattctcacctccacacccccatgtactacttcctcaccaacctgtccttcattgacatgtggttctccactgtcacggtgcccaaaatgctgatgaccttggtgtccccaagcggcagggctatctccttccacagctgcgtggctcagctctattttttccacttcctggggagcaccgagtgtttcctctacacagtcatgtcctatgatcgctacttggccatcagttacccgctcaggtacaccagcatgatgagtgggagcagatgtgccctcctggccaccagcacttggctcagtggctctctgcactctgctgtccagaccatattgactttccatttgccctactgtggacccaaccagatccagcactatttgtgtgatgcaccgcccatcctgaaactggcctgtgcagacacctcagccaacgagatggtcatctttgtggacattgggctagtggcctcgggctgctttctcctgatagtgctgtcttatgtgtccatcgtctgttccatcctgcggatccacacctcagaggggaggcacagagcctttcagacctgtgcctcccactgcatcgtggtcctttgcttttttgttccctgtgttttcatttacctgagaccaggctccagggacgtcgtggatggagttgtggccattttctacactgtgctgacaccccttctcaaccctgttgtgtacaccctgagaaacaaggaggtgaagaaagctgtgttgaaactgagagacaaagtagcacattctcagggagaataa

SEQ ID NO: 4251 - DNA, 1120 bp, Homo sapiens
ggcaaatccaggtatggggaaggctgagaacttttcttcatgcagtaactgacatctccctgtcacatctcaccccaggcacagcctccatgcagagagccaatcactccacagtgacccaattcatcctcgtcggcttctctgtcttcccccacctccagctgatgctcttcctgctgttcctgctgatgtacctgttcacgctgctgggcaacctgctcatcatggccaccgtctggagcgagcgcagcctccacacgcccatgtacctcttcctgtgcgccctctccgtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccgcggggctgcgcctgcctggtgggctgctcctgggctggtggcttggtcatggggatggtggtgacctcggccattttccacctcgccttctgtggacacaaggagatccaccattttgcttgccatgtgccacctctgttgaagttggcctgtggagacgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaagtccccagtctctggaaggagacaccttgatgggcatcacctacacggtcctcacacccttcctcagccccatcatcttcagcctcaggaacaaggagctgaaggtcgccatgaagaagaccttcttcagtaaactctacccagaaaaaaatgtaatgatgtaggagaaattcactgggaacaactaaattggattaccgaaggctattgttaaaaattacgttccgtggtgactcat

SEQ ID NO: 4252 - DNA, 1029 bp, Homo sapiens
cccaactaggggtggccgtcatgctggggctaaaccacacctccatgtctgaattcatcctcgtcggcttctctgccttcccccacctccaactgatgctcttcctgctgttcctgctgatgtacctgttcacgctgctgggcaacctgctcatcatggccaccgtctggagcgagcgcagcctccacacgcccatgtacctcttcctgtgcgtcctctcagtctccgagatcctctacaccgtggccatcatcccgcgcatgctggccgacctgctgtccacccagcgctccatcgccttcctggcctgtgccagtcagatgttcttctccttcagcttcggcttcacccactccttcctgctcaccgtcatgggctacgaccgctacgtggccatctgccaccccctgcgctacaacgtgctcatgagcccacggggctgcgcctgcctggtgggctgctcctgggctggtggctcggtcatggggatggtggtgacctcggccattttccaactgactttctgtggatcccatgagatccagcattttttatgtcatgtgccacctctgttgaagttggcctgtggaaataatgtaccagctgtggccctgggcgtgggcttggtatgtatcatggcactgctgggctgttttctcctcatcctcctctcctatgccttcatcgtggccgacatcttgaagatcccttctgctgaaggtcggaacaaggccttctccacctgtgcctctcaccttattgtggtcattgtgcactatggctttgcctctgtcatctacctcaagcccaaaggtccccactctcaggagggtgacaccctgatggccaccacctacgcagtcctcacgcccttcctcagccccatcatcttcagcctcaggaacaaagaactgaaggttgccatgaagaggaccttcctcagcacactctattcctcaggcacctgagtagctggtgtggaagtgctgatagaatatgataggaggatgaccatcaccttgtctgcac

SEQ ID NO: 4253 - DNA, 951 bp, Homo sapiens
atgcctggtcagaactacagaaccatatctgaatttatcctctctggcttctcagccttcccccagcagctcctgcctgtcttgttcctgctgtacctcctgatgttcctgttcacattgcttggcaaccttcttatcatggccacagtttggattgaacgcagactccacacacccatgtacctcttcttgtgtgccctctccatctctgagattctgttcactgttgccatcacccctcgcatgctggctgatctgctcttcacccatcgttccatcacctttgtggcttgtgccattcagatgttcttctccttcatgtttggcttcactcactccttccttctcatggtcatgggctatgatcactacgtgaccatctgccacccactgcattacaacatgctaatgagtccccgtggctgtgcccatcttgtggcctggacctgggctggtggctcggtcatggggatgatggtgacaatgatggtttttcacctcactttctgtgggtctaatgtgatccaccattttctctgtcatgtgctttccctcttgaagttggcctgtgggagcaagacatcatctgtcatcatgggtgtgatgctggtgtgtgtcacagccctgataggctgtttgttcctcatcatcctctcctttgtcttcattgtggctgccatcttgaggattccttctgctgagggccggcacaagactttctccacttgtgtatcccacctcactgtggtggtcatgcactatagttttgcctcccttatctacctcaaacccaagggcctccattctatgtacagtgatgccttgatggccaccacctatactgtcttcacccccttcctcagcccaatcattttcagtctaaggaacaaggagctgaagaatgccataaataaaaacttttgcagaaggttctgccctctaagctcctaa

SEQ ID NO: 4254 - DNA, 951 bp, Homo sapiens
atgcctagtcagaactatagcatcatatctgaatttaacctctttggcttctcagccttcccccagcacctcctgcccatcttgttcctgctgtacctcctgatgttcctgttcacattgctgggcaaccttctcatcatggccacaatctggattgaacacagactccacacacccatgtacctcttcttgtgcaccctctccgtctctgagattctgttcactgttgccatcacccctcgcatgctggctgatctgctttccacccatcattccatcacctttgtggcttgtgccaaccagatgttcttctccttcatgtttggcttcactcactccttccttctcctggtcatgggctatgatcgctatgtggccatctgccacccactgcgttacaatgtgctcatgagcccccgtgactgtgcccatcttgtggcctgtacctgggctggtggctcagtcatggggatgatggtgacaacgatagttttccacctcactttctgtgggtctaatgtgatccaccattttttctgtcatgtgctttccctcttgaagttggcctgtgaaaacaagacatcatctgtcatcatgggtgtgatgctggtgtgtgtcacagccctgataggctgtttattcctcatcatcctctcctatgtcttcattgtggctgccatcttgaggattccctctgccgaaggccggcacaagacattttctacgtgtgtatcccacctcactgtggtggtcacgcactatagttttgcctcctttatctacctcaagcccaagggcctccattctatgtacagtgacgccttgatggccaccacctatactgtcttcacccccttccttagcccaatcattttcagcctaaggaacaaggagctgaagaatgccataaataaaaacttttacagaaaattctgtcctccaagttcctga

SEQ ID NO: 4255 - DNA, 1132 bp, Homo sapiens
cgctctcagatgtcctcccaggtgggagtcactagacacccctgtgctcctaaccactgggtcttctttcctctctccaccaactaggggtggccgccatgcaggggctaaaccacacctccgtgtctgaattcatcctcgttggcttctctgccttcccccacctccagctgatgctcttcctgctgttcctgctgatgtacctgttcacgctgctgggcaacctgctcatcatggccactgtctggagcgagcgcagcctccacatgcccatgtacctcttcctgtgtgccctctccatcaccgagatcctctacaccgtggccatcatcccgcgcatgctggccgacctgctgtccacccagcgctccatcgccttcctggcctgtgccagtcagatgttcttctccttcagcttcggcttcacccactccttcctgctcactgtcatgggctacgaccgctacgtggccatctgccaccccctgcgttacaacgtgctcatgagcctgcggggctgcacctgccgggtgggctgctcctgggctggtggcttggtcatggggatggtggtgacctcggccattttccacctcgccttctgtggacacaaggagatccaccatttcttctgccacgtgccacctctgttgaagttggcctgtggagatgatgtgctggtggtggccaaaggcgtgggcttggtgtgtatcacggccctgctgggctgttttctcctcatcctcctctcctatgccttcatcgtggccgccatcttgaagatcccttctgctgaaggtcggaacaaggccttctccacctgtgcctctcacctcactgtggtggtcgtgcactatggctttgcctccgtcatttacctgaagcccaaaggtccccagtctccggaaggagacaccttgatgggcatcacctacacggtcctcacacccttcctcagccccatcatcttcagcctcaggaacaaggagctgaaggtcgccatgaagaagacttgcttcaccaaactctttccacagaactgctgaaatggctgactttctctcaagagatgtagcgaatgggaacactttagtcttcctcctttatttcttttcctttcctccctccctcc

SEQ ID NO: 4256 - DNA, 1089 bp, Homo sapiens
tgtgcttctactgctttactgggactatgtgacttttatgcttttatgtttcagatttgggaaccaatccatgaaaagagagaactttactctcatcactgactttgttttccaaggtttctctagcttccatgagcagcagatcaccctttttggcgtgttccttgcactatacatcttaaccttagcaggcaatatcatcattgtgaccatcatccgaatggatcttcatcttcacacacccatgtacttcttcctgagcatgctgtccacttcagagactgtatatacattggtcattctcccaagaatgctctccagcctcgtaggtatgagccagcccatatcattggcagggtgtgccacacagatgttcttttttgtaacctttggcatcactaactgcttcctgctcacagcaatgggatatgaccgctatgtggccatctgcaaccccctgagatacatggttattatgaacaagaggctgcgtatccaacttgtcctgggggcctgcagcattgggctgattgtagcaataacgcaagtgacatctgtattcaggttacccttctgtgctagaaaggtgccccacttcttctgtgacatccgccctgtgatgaagctctcctgcattgacaccactgtcaatgaaatcctgactttgattatcagtgtgctggtgcttgttgtacctatgggtctggttttcatttcttatgttctcattatctctacaatcctcaagattgcttcagttgagggccggaagaaggcttttgccacctgtgcatcccacctcactgtggtcattgtccactacagctgtgcctccattgcctacctcaagcccaagtcagagaacaccagagaacatgaccagctgatctcggtgacctacactgtcatcactcccctactgaaccctgtggtatacaccctgagaaataaagaggtcaaagatgctctgtgcagggctgttggtgggaagttttcctgaccatgtaggaagagttctcctgaggctgtcaacatccacactaggcaggaatatgaggtgtaaactcacaaacacttggctcctagaga

SEQ ID NO: 4257 - DNA, 990 bp, Homo sapiens
atgccaaagctaaattccacttttgtgactgagttcctctttgaaggtttctccagcttcaggcggcagcacaaacttgtcttctttgttgtcttcctaactttgtacctgctgactctctctggcaatgtgattatcatgaccattattcgcctggaccatcatcttcacacccccatgtacttcttcctgtgcatgctatccatctctgagacctgctacactgtggccatcattccccatatgctttctggtctcttgaatcctcatcagcccattgccacccaaagctgtgccactcagctcttcttctatctcacctttggcatcaacaactgcttcctgctcacagtcatgggatatgaccgctatgtggccatctgcaaccccctaaggtattcagtcatcatgggtaagagggcctgtatccaactggcctctggatcactggggattggccttggcatggccattgtccaagtaacatctgtgtttggcctgccattctgtgatgcctttgtcatctcccacttcttctgtgatgtgagacacctgctgaagctggcctgcacagacaccactgtcaatgagataatcaactttgttgtcagcgtctgtgtccttgttctacctatgggcctggtctttatctcctatgtcctcatcatctccaccattcttaagattgcctcagctgaaggtcagaagaaggcctttgccacctgcgcctcccacctcacagtggtcatcatccactatggctgtgcctccatcatctacctgaagcctaagtcccagagttccctgggacaggacagactcatctcagtgacctacactcatcactcccctactgaaccctgttgtgtacagcctgaagaacaaggaggtcaaagatgctctgcacagagccgtggggcaaaaaactctgtctccttaatgaagagaggttgtgaaggcttttcctttgcgtttataaatatgtactaa

SEQ ID NO: 4258 - DNA, 1050 bp, Homo sapiens
tccttgttgactccatttgttgctttcagacactgatatagcagaatgaagagaaagaacttcacagaagtgtcagaattcattttcttgggattttctagctttggaaagcatcagataaccctctttgtggttttcctaactgtctacattttaactctggttgctaacatcatcattgtgactatcatctgcattgaccatcatctccacactcccatgtatttcttcctaagcatgctggctagttcagagacggtgtacacactggtcattgtgccacgaatgcttttgagcctcatttttcataaccaacctatctccttggcaggctgtgctacacaaatgttcttttttgttatcttggccactaataattgcttcctgcttactgcaatggggtatgaccgctatgtggccatctgcagacccctgagatacactgtcatcatgagcaagggactatgtgcccagctggtgtgtgggtcctttggcattggtctgactatggcagttctccatgtgacagccatgttcaatttgccgttctgtggcacagtggtagaccacttcttttgtgacatttacccagtcatgaaactttcttgcattgataccactatcaatgagataataaattatggtgtaagttcatttgtgatttttgtgcccataggcctgatatttatctcctatgtccttgtcatctcttccatccttcaaattgcctcagctgagggccggaagaagacctttgccacctgtgtctcccacctcactgtggttattgtccactgtggctgtgcctccattgcctacctcaagccgaagtcagaaagttcaatagaaaaagaccttgttctctcagtgacgtacaccatcatcactcccttgctgaaccctgttgtttacagtctgagaaacaaggaggtaaaggatgccctatgcagagttgtgggcagaaatatttcttaatggattggattatttcattaagagaccattagcccagtgtagtgtgtctactcacaaacatgccacaatacacaa

SEQ ID NO: 4259 - DNA, 1073 bp, Homo sapiens
tttcccgtacatttccactctcctttctggatcctggtttctacctctgtccctgactctcctttatagaagtgctctccatggagcaagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactcccatgtacttcttccttgccatcctttcttgctctgagatttgctatacctttgtcattgtacccaagatgctggttgacctgctgtcccagaagaagaccatttctttcctgggctgtgccatccaaatgttttccttcctcttctttggctcctctcactccttcctgctggcagccatgggctatgatcgctatatggccatctgtaacccactgcgctactcagtgctcatgggacatggggtgtgtatgggactaatggctgctgcctgtgcctgtggcttcactgtctccctggtcaccacctccctagtatttcatctgcccttccactcctccaaccagctccatcacttcttctgtgacatctcccctgtccttaaactggcatctcagcactccggcttcagtcagctggtcatattcatgcttggtgtatttgccttggtcattcctctgctacttatcctagtctcctacatccgcatcatctctgccattctaaaaatcccttcctccgttggaagatacaagaccttctccacctgtgcctcccatctcattgtggtaactgttcactacagttgtgcctctttcatctacttaaggcccaagactaattacacttcaagccaagacaccctaatatctgtgtcatacaccatccttaccccattgttcaatccaatgatttatagtctgagaaataaggaattcaaatcagccctacgaagaacaatcggccaaactttctatcctcttagttaaagagctattttttaaactactaatgcctagtacatgccaggcagaacgtgt

SEQ ID NO: 4260 - DNA, 939 bp, Homo sapiens
atggagcgggtcaatgagactgtggtgagagaggtcatcttcctcggcttctcatccctggccaggctgcagcagctgctctttgttatcttcctgctcctctacctgttcactctgggcaccaatgcaatcatcatttccaccattgtcctggacagggcccttcatatccccatgtacttcttccttgccatcctctcttgctctgagatttgctacaccttcatcattgtacccaagatgctggttgacctgctgtcccagaagaagaccatttctttcctgggctgtgccatccaaatgttttccttcctcttccttggctgctctcactcctttctgctggcagtcatgggttatgatcgttacatagccatctgtaacccactgcgctactcagtgctaatgggacatggggtgtgtatgggactagtggctgctgcctgtgcctgtggcttcactgttgcacagatcatcacatccttggtatttcacctgcctttttattcctccaatcaactacatcacttcttctgtgacattgctcctgtcctcaagctggcatctcaccataaccactttagtcagattgtcatcttcatgctctgtacattggtcctggctatccccttattgttgatcttggtgtcctatgttcacatcctctctgccatacttcagtttccttccacactgggtaggtgcaaagctttttctacctgtgtatctcacctcattattgtcactgtccactatggctgtgcctcctttatctacttaaggcctcagtccaactactcctcaagccaggatgctctaatatcagtatcctacactattataactccattgttcaacccaatgatttatagcttgagaaataaagagttcaaatcagctctttgtaaaattgtgagaagaacaatttccctgttgtaa

SEQ ID NO: 4261 - DNA, 995 bp, Homo sapiens
cttggctgtgcctcagcttctggcctggagtgatggctggggaaaaccatactacactgcctgaattcctccttctgggattctctgacctcaaggccctgcagggccccctgttctgggtggtgcttctggtctacctggtcaccttgctgggtaactccctgatcatcctcctcacacaggtcagccctgccctgcactcccccatgtacttcttcctgcgccaactctcagtggtggagctcttctacaccactgacatcgtgcccaggaccctggccaatctgggctccccgcatccccaggccatctctttccagggctgtgcagcccagatgtacgtcttcattgtcctgggcatctcggagtgctgcctgctcacggccatggcctatgaccgatatgttgccatctgccagcccctacgctattccaccctcttgagcccacgggcctgcatggccatggtgggtacctcctggctcacaggcatcatcacggccaccacccatgcctccctcatcttctctctaccttttcgcagccacccgatcatcccgcactttctctgtgacatcctgccagtactgaggctggcaagtgctgggaagcacaggagcgagatctccgtgatgacagccaccatagtcttcattatgatccccttctctctgattgtcacctcttacatccgcatcctgggtgccatcctagcaatggcctccacccagagccgccgcaaggtcttctccacctgctcctcccatctgctcgtggtctctctcttctttggaacagccagcatcacctacatccggccgcaggcaggctcctctgttaccacagaccgcgtcctcagtctcttctacacagtcatcacacccatgctcaaccccatcatctacacccttcggaacaaggacgtgaggagggccctgcgacacttggtgaagaggcagcgcccctcaccctgaagggactcggatgtctgctca

SEQ ID NO: 4262 - DNA, 1037 bp, Homo sapiens
cagccaagaagagctcagcgcgtcctattcttttgcataagacatgcctgtggggaaacttgtcttcaaccagtctgagcccactgagtttgtgttccgtgcgttcaccacagccactgaattccaggttcttctcttccttctcttcctcctcctctacttgatgatcctctgtggcaacacagccatcatctgggtggtgtgcacacacagcaccctccgcaccccgatgtatttcttcctgtccaacctgtctttcctggaactctgctacaccaccgtggtagtacccttgatgctttccaacattttgggggcccagaagcccatttcgttggctggatgtggggcccaaatgttcttctttgtcaccctcggcagcacggactgtttcctcttggcgatcatggcctatgaccgctatgtggctatctgccacccgctgcactacaccctcatcatgacccgcgagctgtgcacgcagatgctgggtggggccctgggcctggccctcttcccctccctgcagctcaccgccttaatcttcaccctgcccttttgcggccaccaccaggaaatcaaccacttcctctgcgatgtgcctcccgtcctgcgcctggcctgcgctgacatccgcgtgcaccaggctgtcctctatgtcgtgagcatcctcgtgctgaccatccccttcctgctcatctgcgtctcctacgtgttcatcacctgtgccatcctgagcatccgttctgccgagggccgccgccgggccttctccacctgctccttccacctcaccgtggtcctgctgcagtatggctgctgcagcctcgtgtacctgcgtcctcggtccagcacctcagaggatgaggacagccaaatcgcgttggtctacacctttgtcacccccttactcaaccctttgctttacagccttaggaacaaggatgtcaaaggtgctctgaggagtgccattatccgtaaagcagcctctgacgccaactgaaggcttaggggcactgggctgggtgtctgtctgt

SEQ ID NO: 4263 - DNA, 1008 bp, Homo sapiens
atgccccaaattcttatattcacatacctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcttagtggcaatgtcaccattatcagtgtcatccacctggataaaagcctccacacaccaatgtacttcttccttggcattctctcaacatctgagaccttctacacctttgtcattctacccaagatgctcatcaatctactttctgtggccaggacaatctccttcaactgttgtgctcttcaaatgttcttcttccttggttttgccattaccaactgcctgctattgggtgtgatgggttatgatcgctatgctgccatttgtcaccctctgcattaccccactcttatgagctggcaggtgtgtggaaaactggcagctgcctgtgcaattggtggcttcttggcctctcttacagtagtaaatttagttttcagcctccctttttgtagcgccaacaaagtcaatcattacttctgtgacatctcagcagtcattcttctggcttgtaccaacacagatgttaacgaatttgtgatattcatttgtggagttcttgtacttgtggttccctttctgtttatctgtgtttcttatctctgcattctgaggactatcctgaagattccctcagctgagggcagacggaaagcgttttccacctgcgcctctcacctcagtgttgttattgttcattatggctgtgcttccttcatctacctgaggcctacagcaaactatgtgtccaacaaagacaggctggtgacggtgacatacacgattgtcactccattactaaaccccatggtttatagcctcagaaacaaggatgtccaacttgctatcagaaaagtgttgggcaagaaaggttctctaaaactatataattga

SEQ ID NO: 4264 - DNA, 1121 bp, Homo sapiens
gaccaaggtggtgtggcttgatggataatgacatctcaggaaagggatacagctatttattccattaatgtcagttttgttgcaaaggggatgactagccgctctgtgtgtgagaagatgaccatgacaacggagaaccccaaccagactgtggtgagccacttcttcctggagggtttgaggtacaccgctaaacattctagcctcttcttcctcctcttcctcctcatctacagcatcactgtggctgggaatctcctcatcctcctaactgtgggctctgactctcacctcagcttacccatgtaccacttcctggggcacctctccttcctggatgcctgtttgtctacagtgacagtgcccaaggtcatggcaggcctgctgactctggatgggaaggtgatctcctttgagggctgtgccgtacagctttattgcttccactttctggccagcactgagtgcttcctgtacacagtcatggcctatgaccgctatctggctatctgtcaacccctgcactacccagtggccatgaacagaaggatgtgtgcagaaatggctggaatcacctgggccataggtgccacgcacgctgcaatccacacctccctcaccttccgcctgctctactgtgggccttgccacattgcctacttcttctgcgacataccccctgtcctaaagctcgcctgtacagacaccaccattaatgagctagtcatgcttgccagcattggcatcgtggctgcaggctgcctcatcctcatcgttatttcctacatcttcatcgtggcagctgtgttgcgcatccgcacagcccagggccggcagcgggccttctccccctgcactgcccagctcactggggtgctcctgtactacgtgccacctgtctgtatctacctgcagcctcgctccagtgaggcaggagctggggcccctgctgtcttctacacaatcgtaactccaatgctcaacccattcatttacactttgcggaacaaggaggtgaagcatgctctgcaaaggcttttgtgcagcagcttccgagagtctacagcaggcagcccacccccatagtctgtgctatcaaaactcacaatttgcctgccagg

SEQ ID NO: 4265 - DNA, 945 bp, Homo sapiens
atgcgaggtttcaacaaaaccactgtggttacacagttcatcctggtgggtttctccagcctgggggagctccagctgctgctttttgtcatctttcttctcctatacttgacaatcctggtggccaatgtgaccatcatggccgttattcgcttcagctggactctccacactcccatgtatggctttctattcatcctttcattttctgagtcctgctacacttttgtcatcatccctcagctgctggtccacctgctctcagacaccaagaccatctccttcatggcctgtgccacccagctgttctttttccttggctttgcttgcaccaactgcctcctcattgctgtgatgggatatgatcgctatgtagcaatttgtcaccctctgaggtacacactcatcataaacaaaaggctggggttggagttgatttctctctcaggagccacaggtttctttattgctttggtggccaccaacctcatttgtgacatgcgtttttgtggccccaacagggttaaccactatttctgtgacatggcacctgttatcaagttagcctgcactgacacccatgtgaaagagctggctttatttagcctcagcatcctggtaattatggtgccttttctgttaattctcatatcctatggcttcatagttaacaccatcctgaagatcccctcagctgagggcaagaaggcctttgtcacctgtgcctcacatctcactgtggtctttgtccactatggctgtgcctctatcatctatctgcggcccaagtccaagtctgcctcagacaaggatcagttggtggcagtgacctacacagtggttactcccttacttaatcctcttgtctacagtctgaggaacaaagaggtaaaaactgcattgaaaagagttcttggaatgcctgtggcaaccaagatgagctaa

SEQ ID NO: 4266 - DNA, 1042 bp, Homo sapiens
taggtccaatactctactcatggaaggaataaataaaactgcaaagatgcagtttttctttcgtccattctcacctgaccctgaggtccagatgctgatttttgtggtcttcctgatgatgtatctgaccagcctcggtggaaatgctacaattgcagtcattgttcagatcaatcattccctccacacccccatgtactttttcctggctaatctggcagttctagaaatcttctatacatcttccatcaccccattggccttggcaaacctcctttcaatgggcaaaactcctgtttccatcacgggatgtggcacccagatgtttttctttgtcttcttgggtggggctgattgtgtcctgctggtagtcatggcttatgaccagtttatagcgatctgtcaccctctgcgatacaggctcatcatgagctggtccttgtgtgtggagctgctggtaggctccttggtgctggggttcctgttgtcactgccactcaccattttaatcttccatctcccattctgccacaatgatgagatctaccacttctactgtgacatgcctgcagtcatgcgcctggcttgtgcagacacacgcgttcacaagactgctctgtatatcatcagcttcatcgtccttagcatccccctctcattgatctccatctcctatgtcttcatcgtggtagccattttacggatccggtcagcagaagggcgccagcaagcctactctacctgctcttctcacatcttagtggtcctcctgcagtatggctgcaccagctttatatacttgtcccccagttccagctactctcctgagatgggccgggtggtatctgtggcctacacatttatcactcccattttaaaccccttgatctatagtttgaggaacaaggaactgaaagatgccctaaggaaagcattgagaaaattctaggtaggatgatcctatgatttacttaaattgggacacttctgagagtgaaatgggatgctactaataattttgctgaaaggacatgcataggtg

SEQ ID NO: 4267 - DNA, 1469 bp, Homo sapiens
tcccttaccttaatgatttctagccccaagaattccttgacactttcttgtgaatttgctgaaagaattgaattttcattccactctttctgaaaatagctcctgaatcccacccacttcctctgccatttttcttcaatagtatcttacatagtttggcccaactcttggcaggtagaaattgaggtgtagatattaatgtggagaaacttggtaaaagtggagaaaagaaaaagaactagtcttgatccttccagtttctaactccagtgctgattacattagattcatggctcagagtgtaacttaatttatcttcagtctgattcttccttctgtacttgtagctctccacagagaaatactgttagctcaattacctgggaaaatcactcagtgttgatggaatttgtgttcctggcctatccctcctgcccagaactgcatattctgtccttccttggggtcagcctggtttatggtttgatcatcactgggaacattctcattgtggtgtccattcacacagaaacctgtctatgcacatccatgtactatttcctgggcagcctttctgggattgaaatatgctacactgcagtggtggtgccccatatcctggccaacaccctacagtcagagaagaccatcactctcctgggctgtgccacccagatggctttcttcattgcactgggcagtgctgattgcttcctcttggctgccatggcctatgaccgctatgtggccatttgccacccgttgcagtaccctctcctcatgacattgactctttgtgtccacttggttgtggcatcagtcatcagtggtctgttcctgtccttacaactggtggccttcatcttctctctgccattctgccaggctcagggcattgagcacttcttttgtgatgtgccaccagtcatgcatgttgtttgtgctcagagtcacattcatgagcagtcagtgctggtggcagccatactagccattgctgtgcctttcttcctcatcaccacctcctacaccttcatagtggctgctctgctcaagatccactcggctgctggccgccaccgggccttctccacctgctcttcccacctcactgtggtgctgctgcagtatggctgctgtgccttcatgtacctgtgccccagctccagctacaaccccaagcaagatcggttcatctcactggtgtacacattgggaaccccactgctcaacccacttatctatgccctgaggaacagtgagatgaaaggggccgtagggagagttcttaccaggaactgcctttcccagaacagctaggaaagacgaggggacagcctatcaggcaagtatttggttccagcccaccaaatctgtatgaaactgagatttctatcatttggtgttaaaactcatctaaaagatggtataaattatatggatactgtttatgtgtgccaaagattttt

SEQ ID NO: 4268 - DNA, 981 bp, Homo sapiens
atggtgttgaatgtttattgttgtttctttcaaatttcagacattcaaacgatgaagatcaaccagacaatcctgaaggaattcattcttgttggcttttctgtgtacccacatgtacagacatttctttttgtggtcttcttttgtctctaccttctcacccttgcaggtaatctgatcatcatgggtctaacttgggtggacaggtccctccacacccctatgtatctcttccttagtgcactctccttctctgagacctgctatacgctgaccatcgtccccaagatgctggaagatctactggccaaggacagaagcatttcagtcacaggttgtagcttacagatgtgcttcttcttgggacttggtggcacaaactgtatcattctcactttgatgggatatgaccgcttcctggccatctgtaaccctctaagatatccactgcttatgaccaacattgtatgtggacaacttgtggcctctgcttgcactgcaggcttctttatctctcttacagagactgcactgatattcagggactctttctgcagacccaaccttgtcaaacacttcttctgccatatgctggcagttattaggctgtcttgtatagacagtaaccacacagaattcattataacactgatctcagtgtctggtttgctgggtacccttctgctcatcatcctgactgatgtcttcattatttctactgtcctcaggatcccttcagctgagggcaagcagaaggccttcaccacctgtgcctcccacctcaccgtggttataatccactttggttttgcatctattgtttatttgaagccagaagcctcaggagatgacacactcatagcagtcccttatactgtcattacccccttcctcagccccatcatattcagcctgaggaataaggacatgaaaaatgcttttagaagaatgatgggaaacacagttgccttgaaaaaataa

SEQ ID NO: 4269 - DNA, 942 bp, Homo sapiens
atggggcagaccaacgtaacctcctggagggattttgtcttcctgggcttctccagttctggggagttgcagctccttctctttgccttgttcctctctctgtatctagtcactctgaccagcaatgtcttcattatcatagccatcaggctggatagccatctgcacacccccatgtacctcttcctttccttcctatccttctctgagacctgctacactttgggcatcatccctagaatgctctctggcctggctgggggggaccaggctatctcctatgtgggctgtgctgcccagatgttcttttctgcctcatgggcctgtactaactgcttccttctggctgccatgggctttgacagatatgtggccatctgtgctccactccactatgccagccacatgaatcctaccctctgtgcccagctggtcattacttccttcctgactggatacctctttggactgggaatgacactagttattttccacctctcattctgcagctcccatgaaatccagcactttttttgtgacacgccacctgtgctgagcctagcctgtggagatacaggcccgagtgagctgaggatctttatcctcagtcttttggtcctcttggtctccttcttcttcatcaccatctcctacgcctacatcttggcagcaatactgaggatcccctctgctgaggggcagaagaaggccttctccacttgtgcctcgcaccttacagtggtcattattcattatggctgtgcttccttcgtgtacctgaggcccaaagccagctactctcttgagagagatcagcttattgccatgacctatactgtagtgacccccctccttaatcccattgtttatagtctaaggaatagggctatacagacagctctgaggaatgctttcagagggagattgctgggtaaaggatga

SEQ ID NO: 4270 - DNA, 36 bp, Homo sapiens
gtaactccccaaaaactctcattctgcagctcccat

SEQ ID NO: 4271 - DNA, 2229 bp, Homo sapiens
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4272 - DNA, 2482 bp, Homo sapiens
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4273 - DNA, 2611 bp, Homo sapiens
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccactggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4274 - DNA, 2482 bp, Homo sapiens; identical to SEQ ID NO: 4272

SEQ ID NO: 4275 - DNA, 2482 bp, Homo sapiens
caactcttaattggccctcaaaacttagcctacttgcttctatcttcagaaagccttccccgaccttgatcccacaccttctgccccacaaccccaggctgggtttggtccttctctgctcccatggcacctacttccttccctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4276 - DNA, 2611 bp, Homo sapiens; identical to SEQ ID NO: 4273

SEQ ID NO: 4277 - DNA, 2611 bp, Homo sapiens
catcctagcagtgaatggaaacacacatatggggagaaactaaggctccctactaaaaacgtgcaacatgtgactgggacatcttgttgagctcaagcagggagggagctgaaggtaggaaattccaacattctgaagtcttcagcaaatcttagcagatcatctcctcctcacagtcctgtctttagagaacagggtcgatatttcgggaatcctatagaaagactccaagcctcagaatgagtttggaccagataaaataatctagagttaaagatggcccacatagggagtgccagattcactcacaaggaaatgcagatgggatcaaaggttaataaacacatattgctttgaatagcatatgaaaaccttccagcagctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4278 - DNA, 2482 bp, Homo sapiens
caactcttaattggccctcaaaacttagcctacttgcttctatcttcagaaagccttccccgaccttgatcccacaccttctgccccacaaccccaggctgggtttggtccttctctgctcccatggcacctacttccttcgctattaccatttaccacattttcactaccaactcctgaatgacttgatgaaactactatttaaggaaggcaataagtgaagaatatataagaattatccgaggaacagttgctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4279 - DNA, 2611 bp, Homo sapiens; identical to SEQ ID NO: 4277

SEQ ID NO: 4280 - DNA, 2482 bp, Homo sapiens; identical to SEQ ID NO: 4275

SEQ ID NO: 4281 - DNA, 2482 bp, Homo sapiens; identical to SEQ ID NO: 4275

SEQ ID NO: 4282 - DNA, 2611 bp, Homo sapiens; identical to SEQ ID NO: 4277

SEQ ID NO: 4283 - DNA, 2611 bp, Homo sapiens; identical to SEQ ID NO: 4277

SEQ ID NO: 4284 - DNA, 2482 bp, Homo sapiens; identical to SEQ ID NO: 4275

SEQ ID NO: 4285 - DNA, 2611 bp, Homo sapiens; identical to SEQ ID NO: 4277

SEQ ID NO: 4286 - DNA, 2229 bp, Homo sapiens; identical to SEQ ID NO: 4271

SEQ ID NO: 4287 - DNA, 2229 bp, Homo sapiens
ctctaataacgttaggcttggtatagaagatgcagagacatgctaaaatttctcccccaattattgccaagcagaaacttggacgatcgacatggaaattgtctccacaggaaacgaaactattactgaatttgtcctccttggcttctatgacatccctgaactgcatttcttgttttttattgtattcactgctgtctatgtcttcatcatcatagggaatatgctgattattgtagcagtggttagctcccagaggctccacaaacccatgtatattttcttggcgaatctgtccttcctggatattctctacacctccgcagtgatgccaaaaatgctggagggcttcctgcaagaagcaactatctctgtggctggttgcttgctccagttctttatcttcggctctctagccacagctgaatgcttactgctggctgtcatggcatatgaccgctacctggcaatttgctacccactccactacccactcctgatggggcccagacggtacatggggctggtggtcacaacctggctctctggatttgtggtagatggactggttgtggccctggtggcccagctgaggttctgtggccccaaccacattgaccagttttactgtgactttatgcttttcgtgggcctggcttgctcggatcccagagtggctcaggtgacaactctcattctgtctgtgttctgcctcactattccttttggactgattctgacatcttatgccagaattgtggtggcagtgctgagagttcctgctggggcaagcaggagaagggctttctccacatgctcctcccacctagctgtagtgaccacattctatggaacgctcatgatcttttatgttgcaccctctgctgtccattcccagctcctctccaaggtcttctccctgctctacactgtggtcacccctctcttcaatcctgtgatctataccatgaggaacaaggaggtgcatcaggcacttcggaagattctctgtatcaaacaaactgaaacacttgattgaaggagagtaatgaagatgttattttggacttcggacacctccattggggactcttccaggatgggttggagaggagtaactttgtcttattcgaccattctctttgaactcttctgcagttatactaaaaatgaaaatgatagggcaacaattttttaacttttattttaagttcaagggtacatgtgcaggtttgttacataggtaaacttgtgtcatgggggtttactgtacagattatttcatcacccaggtattaagcctagtactcattaatcatttttcctgatcttctccctcctcccaacctccaccctcaagtaggattcagtgtgttgttcccctctatgtatccatatgttttcataatttagctcccacttatgagtgaagacatacggtatttgattttctgttcctgtgttagtttgcgaaggatagtagcctccaattccatccatgtcaaataatcaaaattatttaaactttgattagttctttattaaatatgtcataaatatttaaaaataatacagcaataccaaaataaacctagaaatattgttttttatattattgttgtatgacatttaaaaatttctttctatgtgtatttatatttatacatacaagttggatcatggagtttgtaatctggttttccactgaacactgtgtcacgaacaactttttctattaacaagcatctatttctttattcttctgggcttcatcgtatggctaaacatgatttgttattctattttgggaatttttagttgtattctattcttttactgtacattgtttacatctggattttcctgtaataaacttttagcacctaaattgcaagatctaaggatatgtgtttttaaaaatctaaagctgaattccttttcttttaaacttcttttcttgtagaacatttcaaacatacataaaagagaagagcacagtgaacccccatgtactccatgtagccaccatccagcttcaacatcaacattttgctaatcttattttaattagctacagctccttgtttgttagttttcatggaaaattttagggcaaattccagatgttgtataactattatgttgtgtaagttatgtatgtacatattccacatatgtatttagtataatctgtgactaataaagacattttaaaaaaccatgcccaca

SEQ ID NO: 4288 - DNA, 2229 bp, Homo sapiens; identical to SEQ ID NO: 4287

SEQ ID NO: 4289 - DNA, 2229 bp, Homo sapiens; identical to SEQ ID NO: 4287

SEQ ID NO: 4290 - DNA, 2229 bp, Homo sapiens; identical to SEQ ID NO: 4287

SEQ ID NO: 4291 - DNA, 2229 bp, Homo sapiens; identical to SEQ ID NO: 4287

SEQ ID NO: 4292 - DNA, 1111 bp, Homo sapiens
atgcattttctttcccaaaatgatttaaatataaatctgattccccatctatgtttgcaccgtcattcagtaattgctggtgcttttacaattcacaggcacatgaaaatcttcaacagccccagcaactccagcaccttcactggcttcatcctcctgggcttcccttgccccagggaggggcagatcctcctctttgtgctcttcactgttgtttacctcctgaccctcatgggcaatggttccatcatctgtgctgtgcactgggatcagagactccacgcccccatgtacatcctgctcgccaacttctccttcttggagatatgttatgtcacctccacagtccccagcatgctggccaacttcctctctgacaccaagatcatctcgttctctggctgcttcctccagttctactttttcttctccttgggctctacagaatgctttttcctggcagttatggcatttgatcgataccttgccatctgtcggcctctacgctatccaaccattatgaccagacgtctctgtaccaatcttgtggtcaattgctgggtacttggtttcatctggttcttgattcctatcgtcaacatctcccaaatgtccttctgtggatctaggattattgaccacttcctatgtgacccagctcctcttctaactctcacttgcaaaaaaggccctgtgatagagcttgtcttttctgtcttaagtcctctgcctgtctttatgctctttctcttcattgtggggtcctatgctctggtcgtgagagctgtgttgagggtcccttcagcagctgggagaagaaaggctttctccacctgtgggtctcacctggctgtggtttcactgttctacggctcagtactggtcatgtatgggagcccaccatctaagaatgaagctggaaagcagaagactgtgactctgttttattctgttgttaccccactgcttaaccctgtgatatatagtcttaggaacaaagatatgagaaaagctctgaagaaattttggggaacataaaatgttaatcaaaaaggtccttgcgtaattaatcttgtctttaattttggggtttaaaaaaaaaactggtctt

SEQ ID NO: 4293 - DNA, 982 bp, Homo sapiens
aatgtgtcccttgaccttgcaggtcactggcctaatgaatgtctctgagccaaattccagctttgcttttgtaaatgaatttatactccaaggtttctcttgtgagtggacaattcagatcttcctcttctcactctttactacaacatatgcactgactataacagggaatggagccattgcttttgtcctgtggtgtgaccggcgacttcacactcccatgtacatgttcctgggaaatttctcctttttagagatatggtatgtctcttctacagttcccaagatgttggtcaacttcctttcagagaaaaaaaacatctcctttgctggatgttttctccagttttatttcttcttctctttgggtacatcagaatgcttgcttttgactgtgatggcctttgatcagtaccttgctatctgccgtcccttgctctatcctaatatcatgactgggcatctctatgccaaactggtcatactgtgctgggtttgtggatttctgtggttcctgatccccattgttctcatctctcagatgcccttctgtggcccaaacattattgaccatgttgtgtgtgacccagggccacgatttgcattggattgtgtttctgccccaagaatccaactgttttgctacactctaagctcattagttatttttggtaacttcctctttattattggatcctatactcttgtcctgaaagctatgttgggtatgccttcaagcactgggagacataaggccttctctacctgtgggtctcatttggctgtggtatcactgtgctatagctctcttatggtcatgtatgtgagcccaggactcggacattctacagggatgcagaaaattgaaactttgttctatgctatggtgaccccactcttcaatccccttatctatagcctccagaataaggagataaaggcagccctgaggaaagttctggggagttccaacataatctaa

SEQ ID NO: 4294 - DNA, 1082 bp, Homo sapiens
tgagatacgtagcaagcaattggattacactccaagagacttggattacactcatgtctttcttctttgtagacttaagacccatgaacaggtcagcaacacacatcgtgacagagtttattctcctgggattccctggttgctggaagattcagattttcctcttctcattgtttttggtgatttatgtcttgaccttgctgggaaatggagccatcatctatgcagtgagatgcaacccactactacacacccccatgtactttctgctgggaaattttgccttccttgagatctggtatgtgtcctccactattcctaacatgctagtcaacattctctccaagaccaaggccatctcattttctgggtgcttcctccagttctatttcttcttttcactgggaacaactgaatgtctctttctggcagtaatggcttatgatcgatacctggccatctgccacccactgcagtaccctgccatcatgactgtaaggttctgtggtaagctggtgtctttctgttggcttattggattccttggatacccaattcccattttctacatctcccaactccccttctgtggtcctaatatcattgatcacttcctgtgtgacatggacccattgatggctctatcctgtgccccagctcccataactgaatgtattttctatactcagagctcccttgtcctctttttcactagtatgtacattcttcgatcctatatcctgttactaacagctgtttttcaggtcccttctgcagctggtcggagaaaagccttctctacctgtggttctcatttggttgtggtatctcttttctatgggacagtcatggtaatgtatgtaagtcctacatatgggatcccaactttattgcagaagatcctcacactggtatattcagtaacgactcctctttttaatcctctgatctatactcttcgtaataaggacatgaaactcgctctgagaaatgtcctgtttggaatgagaattcgtcaaaattcgtgagccaaagatgtgccatacttacaagttctaacgaagaacaaggtcgagatgttg

SEQ ID NO: 4295 - DNA, 1174 bp, Homo sapiens
tcattaggaagaccaaatgagataatgtatgtaaaaatacttagtacatcatccagcatgagttagcaaaatctccaaatgttctttattattcattctttggttacttctgtttttctaacagctttgggaccccagaacagaacaatgcattttgtgactgagtttgtcctcctgggtttccatggtcaaagggagatgcagagctgcttcttctcattcatcctggttctctatctcctgacactgctagggaatggagctattgtctgtgcagtgaaattggacaggcggctccacacacccatgtacatccttctgggaaactttgcctttctagagatctggtacatttcctccactgtcccaaacatgctagtcaatatcctctctgagattaaaaccatctccttctctggttgcttcctgcaattctatttctttttttcactgggtacaacagagtgtttctttttatcagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactgagatatctttgaaaaagaagccaaattggccacttctgaccttaattttttataactatagagagtagcttcagtagtatgttctggctcacactcaggtagac

SEQ ID NO: 4296 - DNA, 1056 bp, Homo sapiens
aaatttgcgccttgcatcctgtgcttttccagaatgtttttcatcccccacaggcaatggagccccaaaatacctccactgtgactaactttcagctgttaggattccagaaccttcttgaatggcaggccctgctctttgtcattttcctgctcatctactgcctgaccattatagggaatgttgtcatcatcaccgtggtgagccagggcctgcgactgcactcccctatgtacatgttcctccagcatctctcctttctggaggtctggtacacgtccaccactgtgccccttctcctagccaacctgctgtcctggggccaagccatctccttctctgcctgcatggcacagctctacttcttcgtattcctcggcgccaccgagtgctttctcctggccttcatggcctatgaccgttacctggccatctgcagcccactccgctaccccttcctcatgcatcgtgggctctgtgccaggttggtggtggtctcctggtgcacaggggtcagcacaggctttctgccttccctgatgatttccaggttggacttctgtgggcgcaatcagattaaccatttcttctgcgacctcccgccactcatgcagctctcctgttccagagtttatatcaccgaggtgaccatcttcatcctgtcaattgccgtgctgtgcatttgtttttttctgacactggggccctatgttttcattgtgtcctccatattgagaatcccttccacctctggccggagaaagaccttttccacatgtggctcccacctggctgttgtcactctctactacgggaccatgatctccatgtatgtgtgtcccagtccccacctgttgcctgaaatcaacaagatcatttctgtcttctacactgtggtcacaccactgctgaacccagttatctacagcttgaggaacaaagacttcaaagaagctgttagaaaggtcatgagaaggaaatgtggtattctatggagtacaagtaaaaggaagttcctttattaggtaaagaaaattgcacagaacatgcagtgga

SEQ ID NO: 4297 - DNA, 1033 bp, Homo sapiens
gccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattgtcatctccgatcctagactccattcccttatgtatttcttcctgggaaacctgtcctacctggatatctgttactctacggtgacactgccaaaaatgctgcagaactttctctctacacacaaagcaatttctttcttgggatgcataagccagcttcatttcttccactccctgggcagcacggagtccatgttgttcgccgtgatggcatttgacctctctgtggctatctgcaagccacttcgctacactgtcatcatgaaccctcagctctgtacccagatggccatcacaatctgggtcattggttttttccatgccctgctgcactccgtaatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttcttttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactctactgaggcataaataaccagcaatga

SEQ ID NO: 4298 - DNA, 1033 bp, Homo sapiens
gccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattttcatctccgatcctagactccattcccctatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttggccgtgatggcatttgaccgctctgtggctatctgcaagccacttcgctacactgtcatcatgaaccctcagctctgtacccagatggccatcacaatctgggtcattggttttttccatgccctgctgcactccataatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttctcttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttgatttgaataaaccagagaactcttctgaggcataaataaccagcaatga

SEQ ID NO: 4299 - DNA, 1069 bp, Homo sapiens
agcttctatacaacttctgaggtttggaagaagtacaacagtactctccttccaagtatctttggcttggtgagaaaattctgagccggaaggattctgattgcgattagtgttccatagattattttgtcttttgtctgaagtgatgctgaatacaacctcagtcaccgaatttctcctcttgggagtgacagacattcaagaactgcagccttttctcttcgtggttttcctcaccatctacttcatcagtgtgactgggaatggagccgttctgatgattttcatctccgatcctagactccattcccctatgtatttcttcctgggaaacctgtcctacctggatatctgttactctacggtgacactgccaaaaatgctgcagaactttctctctacacacaaagcaatttctttcttgggatgcataagccagcttcatttcttccacttcctgggcagcacggagtccatgttgttggccgtgatggcatttgaccgctgtgtggctatctgcaagccacttcgctacactgtcatcatgaaccctcagctctgtacccagatggccatcacaatctgggtcattggttttttccatgccctgctgcactccataatgacttctcgcttgaacttctgtggttccaaccgtatccatcattttctctgtgatattaagccattgctaaagctggcctgtgggaacactgagcttaatcagtggctactcagtactgtcacggggacaattgccatgggccccttctttctgacacttctctcctatttctacattatcacttatctcttcttcaagacccgttcttgtagcatgctctgtaaagcactgtccacttgtgcctcccacttcatggtagttattcttttctatgcacctgttctcttcacctatatccatcctgcgttagagagcttcatggaccaggaccggattgttgccatcatgtacactgtggtcactcctgtactaaacccactgatctatactttgaggaacaaggaagtgaagggggccttgggtagagtgatcagaaggctttga

SEQ ID NO: 4300 - DNA, 2011 bp, Homo sapiens
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaaagtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 4301 - DNA, 2011 bp, Homo sapiens
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcagcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatgtcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 4302 - DNA, 1869 bp, Homo sapiens
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaaagtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 4303 - DNA, 2011 bp, Homo sapiens
aaactgtgctgccacaggcccatttttcggtgagaaagctagaaaagttggaggacttgttctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 4304 - DNA, 2011 bp, Homo sapiens
aaactgtgctgccacaggcccatttttcggtgagaaagctagaaaagttggaggacttattctaagtcacgctgttaccagcctagaggggcatctcagtgttttgagcagcttctcgttttgtgagctttgtggatgagtgagcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 4305 - DNA, 1869 bp, Homo sapiens
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgctcgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcagcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatgtcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtatacattgtgaagagactaccacaatcaagctaaacctacattactgtccctgcattagtttactgttgaatactagaagttcttcgttctatctaactgcattttcatacccattaagccaatgtgacaagctctttgttttagttggagtgtttgcacaatttaaatttgataaatttttgatagaattaaatttaaatttatcctccaactaaatttttgatagaattaaatttaaatttgtcctcca

SEQ ID NO: 4306 - DNA, 1869 bp, Homo sapiens
agcaatggagaatgtcactacaatgaatgagtttcttctacttggcctgactggtgttcaggagctgcagcctttcttctttgggattttcttaatcatttacctgataaacttgattggaaatggatctatattggtgatggttgttttggaaccacaactccactcccctatgtatttttttctgggaaacctttcttgtctggatatttcttattcttcagtgacactgcccaagctgcttgtaaacctcgtgtgcagtcgcagggctatatcttttctaggctgtatcacccagctacacttcttccactttttgggaagcacagaggccattttactggctatcatggcctttgaccgttttgttgccatctgcaatcctcttcgctacactgtcatcatgaacccccaggtgtgtattctgttggcagctgcggcctggctcatcagcttcttttacgctctgatgcattctgtcatgactgcacacctgagtttttgtggctctcagaaactcaatcacttcttctacgatgtcaagccgctcttagaattggcctgtagtgacacattactcaatcaatggcttctttccattgtcacaggcagcatatccatgggagctttctttctgactcttctctcctgcttctatgtaattggcttccttctgtttaagaacaggtcctgcagaatactccacaaggctctgtccacttgtgcctcccattttatggtggtatgtcttttctatggacctgtgggcttcacatatattcgtcctgcttcagccacctccatgattcaggaccggataatggccatcatgtatagcgccgtcacccctgtactgaatccactaatctacacccttaggaacaaagaagtgatgatggctctgaagaaaatctttggtaggaagttgtttaaagactggcagcaacaccactaggactaatgagggatatctgatttctattaagactgatttccatcacttcactgtaagaaatgatttgtttacctggtttatatttttctttcaaaaattttgagcacatattatattaggcagtgtagtaggttcaagaaacacaggagcaagcaaaacaaattccataatgtcatcaaacataaagtttaatgtgatggaggccccaaataaccaaacgcgtaagtacatatgtcaggataattcggtggcaaggagaactaaggaggtaggaagtatggggagggttagagtaggaatctgctgtgtaaaaaagaatgtggcatttctcctaggacaaaaacctttggaattttccaagtaatagaagtatcttactgaaattccatatgagataatctttatttttgcctattttttttccttttgtgtttccttcagcaggaatgtactgatgataatttttctcacaacagtttttatctagaatatcatttttgttaatcttaattcttgaagagaatttttaatgggtatttaattttagggagagatttttctagccattgaaaatatcttgtttttccccagcttattgaagtataattaacaaataaaaattgcatatatttaggcttcacaacatgatgctttagtatatgtacacattgtgaagagactaccacaatcaagctaaacctacattactgtccctgcattagtttactgttgaatactagaagttcttcattctatctaactgcattttcatacccattaagccaatgtgacaagctctttgtttcagttggagtgtttgcacaatttaaatttgataaatttttgatagaattaaatttaaatttatcctccaactaaatttttgatagaattaaatttaaatttgtcctcca

SEQ ID NO: 4307 - DNA, 1869 bp, Homo sapiens; identical to SEQ ID NO: 4306

SEQ ID NO: 4308 - DNA, 1177 bp, Homo sapiens
tgtcctcctgtccccacccaatcacaataagtggtgatgtgaggtgtggaagaaacacgggagcagccttcctcaggacacctcttgtttatctctctagctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggagg

SEQ ID NO: 4309 - DNA, 2023 bp, Homo sapiens
taatccaagatgccttttttcccccttcagaagcttgagtgcccaagggtttgataaatgtggaaaataaccgctgttcgaatatcctgttggcctgctgaagaaatgactggctgaggctgtaaagaaatcttgtggtcattctcatggaaagaggattggagccccgattctttgatctcattattgaccagttgattgagaagactgtcctcctgtccccacccaatcacaataagtggctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggaggtaaatagacttgttttttctaacccagcagaacctgtgcatggatgagctgggagtgctggttccctgagacttggtgatggggggattgcggtaggtgtgacccaccagcctctgagacaccagatctcttggtctgactccaaggtggtgtcagtgctgagttggcagagaaacacagggcctaggaggagaaaagtgttccttgtgttttcaactcatagccacatcaaacattttccttttgtatgtacaacactcagggtgtaaattctaaaatcacacctagaattcagctgtgtgggtctaaaaagttaggcagaattgtggaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatcctctgtgtctaataaagacaggtcttgtgcttgtgctccatgctattac

SEQ ID NO: 4310 - DNA, 2078 bp, Homo sapiens
actatattgaatagaagcgaagagacagagtatacttgtcttgttcctaatccagaagaaaagtttgaatcttttaccattgagtaagcttgagtgcccaagggtttgataaatgtggaaaataaccgctgttcgaatatcctgttggcctgctgaagaaatgactggctgaggctgtaaagaaatcttgtggtcattctcatggaaagaggattggagccccgattctttgatctcattattgaccagttgattgagaagactgtcctcctgtccccacccaatcacaataagtggctctgaaatcacatgaagctgtggatggagagtcacctgatagtcccagaaacccgtcccagcccaaggatgatgagtaaccagacgttggtaaccgagttcatcctgcagggcttttcggagcacccagaataccgggtgttcttattcagctgtttcctcttcctctactctggggccctcacaggtaatgtcctcatcaccttggccatcacgttcaaccctgggctccacgctcctatgtactttttcttactcaacttggctactatggacattatctgcacctcttccatcatgcccaaggcgctggccagtctggtgtcggaagagagctccatctcctacgggggctgcatggcccagctctatttcctcacgtgggctgcatcctcagagctgctgctcctcacggtcatggcctatgaccggtacgcagccatctgccacccgctgcattacagcagcatgatgagcaaggtgttctgcagcgggctggccacagccgtgtggctgctctgcgccgtcaacacggccatccacacggggctgatgctgcgcttggatttctgtggccccaatgtcattatccatttcttctgcgaggtccctcccctgctgcttctctcctgcagctccacctacgtcaacggtgtcatgattgtcctggcggatgctttctacggcatagtgaacttcctgatgaccatcgcgtcctatggcttcatcgtctccagcatcctgaaggtgaagactgcctgggggaggcagaaagccttctccacctgctcttcccacctcaccgtggtgtgcatgtattacaccgctgtcttctacgcctacataagcccggtctctggctacagcgcagggaagagcaagttggctggcctgctgtacactgtgctgagtcctaccctcaaccccctcatctatactttgagaaacaaggaggtcaaagcagccctcaggaagcttttccctttcttcagaaattaacttgtgtcttctgaagtttttgtccttggagactgcagttttagtggagtctgatgagcaagtttctggactgggaggtaaatagacttgttttttctaacccagcagaacctgtgcatggatgagctgggagtgctggttccctgagacttggtgatggggggattgcggtaggtgtgacccaccagcctctgagacaccagatctcttggtctgactccaaggtggtgtcagtgctgagttggcagagaaacacagggcctaggaggagaaaagtgttccttgtgttttcaactcatagccacatcaaacattttccttttgtatgtacaacactcagggtgtaaattctaaaatcacacctagaattcagctgtgtgggtctaaaaagttaggcagaattgtggaccccacagcccctgaagggttgtcagactgaagctttgttttaaggtgaccactggcctctaggaaaccttctacccccattatcttacctcaactgtttcctctggagccacttggacttcaaaaatagtttgattttaatgcaaactgttgtttctgcttttgtcttttcttcttactaacacttcagattctgagtatctgacctacctaattggcctggagcgaggacagctgccatgagtcagctctaataagttaaacggcattgtagtaaggcattgctatccttccattgtttcagataaaactgggtgaacgaatcctctgtgtctaataaagacaggtcttgtgcttgtgctccatgctattac

SEQ ID NO: 4311 - DNA, 1028 bp, Homo sapiens
ttgtcttaacatgctctctcttacaggttaaatagagagtaaaatggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcggcttggccatggggacaacagagtgtgtgcttctgggcatgatggcctttgaccgctatgtggctatctgcaaccctctgagatatcccatcatcatgagtaaggatgcctatgtacccatggcagctgggtcctggatcataggagctgtcaattctgcagtacaatcagtgtttgtggtacaattgcctttctgcaggaataacatcatcaatcatttcacctgtgaaattctggctgtcatgaaactggcctgtgctgacatctcagacaatgagttcatcatgcttgtggccacaacattgttcatattgacacctttgttattaatcattgtctcttacacgttaatcattgtgagcatcttcaaaattagctcttccgaggggagaagcaaagcttcctctacctgttcagcccatctgactgtggtcataatattctatgggaccatcctcttcatgtacatgaagcccaagtctaaagagacacttaattcggatgacttggatgctaccgacaaaattatatccatgttctatggggtgatgactcccatgatgaatcctttaatctacagtcttagaaacaaggatgtgaaagaggcagtaaaacacctactgaacagaaggttctttagcaagtgagtgcaaaatgtactggaatatgaacaca

SEQ ID NO: 4312 - DNA, 1108 bp, Homo sapiens
tcagaacttcaagcaagcactccttctaatatgtgtcaaaagaatgattgttcagttaatttgtactgtttgtttcttggcagtaaatacatttcatgttagatcttcttttgatttcctgaaagcagatgacatgggtgagattaaccagacacttgtgtcagaatttcttcttctgggtctttctggatacccaaagattgagattgtttactttgctctcattctagttatgtacctagtgattctaattggcaatggtgttctaatcatagccagcatctttgattctcattttcacacaccaatgtacttcttcctgggcaacctctctttcctggatatctgctatacatcctcctctgttccctcaacattggtgagcttaatctcaaagaaaagaaacatttccttctctggatgtgcagtgcagatgttctttgggtttgcaatggggtcaacagaatgtctgcttcttggcatgatggcatttgatcgttatgtggccatctgcaacccactgagataccccatcatcctgagcaaggtggcgtatgtattgatggcttctgtgtcctggctgtccggtggaataaattcagctgtgcaaacattacttgccatgagactgcctttctgtgggaataatattatcaatcatttcgcatgtgaaatattagctgtcctcaagctggcctgtgctgatatatccctcaatattatcaccatggtgatatcaaatatggccttcctggttcttccactgatggtcatttttttctcctatatgttcatcctctacaccatcttgcaaatgaattcagccacaggaagacgcaaggcattttccacgtgctcagctcacctgactgtggtgatcatattttacggtaccatcttctttatgtatgcgaaaccgaagtctcaagacctgattggggaagaaaaattgcaagcattagacaagctcatttctctgttttatggggtagtgacacccatgctgaatcctatactctatagcttgagaaataaggatgtaaaagctgctgtaaaatatttgctgaacaaaaaaccaattcactaatgaaaccaggacatgtaggtc

SEQ ID NO: 4313 - DNA, 957 bp, Homo sapiens
atggacaagataaaccagacatttgtgagagaattcattcttctgggactctctggttaccccaaacttgagatcattttctttgctctgattctagttatgtacgtagtgattctaattggcaatggtgttctgatcatagcaagcatcttggattctcgtcttcacatgcccatgtacttcttcctgggcaacctctctttcctggatatctgctatacaacctcctccattccctcaacactggtgagcttaatctcaaagaaaagaaacatttccttctctggatgtgcagtgcagatgttctttgggtttgcaatggggtcaacagaatgtttcctccttggcatgatggcatttgatcgttatgtggccatctgtaaccctctgagataccccatcatcatgaacaaggtggtgtatgtactgctgacttctgtatcatggctttctggtggaatcaattcaactgtgcaaacatcacttgccatgcgatggcctttctgtgggaacaatattattaatcatttcttatgcgagatcttagctgtcctaaaattagcttgttctgatatatctgtcaatattgttaccctagcagtgtcaaatattgctttcctagttcttcctctgctcgtgatttttttctcctatatgttcatcctctacaccatcttgcgaacgaactcggccacaggaagacacaaggcattttctacatgctcagctcacctgactgtggtgatcatattttatggtaccatcttctttatgtatgcaaaacctaagtcccaggacctccttgggaaagacaacttgcaagctacagaggggcttgtttccatgttttatggggttgtgacccccatgttaaaccccataatctatagcttgagaaataaagatgtaaaagctgctataaaatatttgctgagcaggaaagctattaaccagtaa

SEQ ID NO: 4314 - DNA, 1038 bp, Homo sapiens
atgtttattcaagttattttttacatttgttgcttggctgtgaaaatattatacattgggtcttcctttggcatcctgaaagctgacatggacaagataaaccagacatttgtgagagaattcattcttctgggactctctggttaccccaaacttgagatcattttctttgctctgattctagttatgtacgtagtgattctaattggcaatggtgttctgatcatagcaagcatcttggattctcgtcttcacatgcccatgtacttcttcctgggcaacctctctttcctggatatctgctatacaacctcctccattccctcaacactggtgagcttaatctcaaagaaaagaaacatttccttctctggatgtgcagtgcagatgttctttgggtttgcaatggggtcaacagaatgtttcctccttggcatgatggcatttgatcgttatgtggccatctgtaaccctctgagataccccatcatcatgaacaaggtggtgtatgtactgctgacttctgtatcatggctttctggtggaatcaattcaactgtgcaaacatcacttgccatgcgatggcctttctgtgggaacaatattattaatcatttcttatgcgagatcttagctgtcctaaaattagcttgttctgatatatctgtcaatattgttaccctagcagtgtcaaatattgctttcctagttcttcctctgctcgtgatttttttctcctatatgttcatcctctacaccatcttgcgaacgaactcggccacaggaagacacaaggcattttctacatgctcagctcacctgactgtggtgatcatattttatggtaccatcttctttatgtatgcaaaacctaagtcccaggacctccttgggaaagacaacttgcaagctacagaggggcttgtttccatgttttatggggttgtgacccccatgttaaaccccataatctatagcttgagaaataaagatgtaaaagctgctataaaatatttgctgagcaggaaagctattaac

SEQ ID NO: 4315 - DNA, 1139 bp, Homo sapiens
ggcacatattcattgacacatgcttgaaagtaatcagagtaagataaatatttgtcttaacatgctctgtcttacaagctaaagagggagtaaaatggaatgggaaaaccacaccattctggtggaattttttctgaagggactttctggtcacccaagacttgagttactcttttttgtgctcatcttcataatgtatgtggtcatccttctggggaatggtactctcattttaatcagcatcttggaccctcaccttcacacccctatgtacttctttctggggaacctctccttcttggacatctgctacaccaccacctctattccctccacgctagtgagcttcctttcagaaagaaagaccatttccctttctggctgtgcagtgcagatgttcctcagcttggccatggggacaacagagtgtgtgcttctgggcgtgatggcctttgaccgctatgtggctatctgcaaccctctgagatatcccatcatcatgagtaaggatgcctatgtacccatggcagctgggtcctggatcataggagctgtcaattctgcagtacaaacagtgtttgtggtacaattgcctttctgcaggaataacatcatcaatcatttcacctgtgaaattctagctgtcatgaaactggcctgtgctgacatctcaggcaatgagttcatcctgcttgtgaccacaacattgttcctattgacacctttgttattaattattgtctcttacacgttaatcattttgagcatcttcaaaattagctcttcggaggggagaagcaaaccttcctctacctgctcagctcgtctgactgtggtgataacattctgtgggaccatcttcctcatgtacatgaagcccaagtctcaagagacacttaattcagatgacttggatgccactgacaaacttatattcatattctacagggtgatgactcccatgatgaatcctttaatctacagtcttagaaacaaggatgtgaaggaggcagtaaaacacctactgagaagaaaaaattttaacaagtaaatgagaaaggtgagagtaattttataatcacaatatggaaatcaattagagaaaccaaggttaaacagataggttctcgttgctgttt

SEQ ID NO: 4316 - DNA, 963 bp, Homo sapiens
atggaaaggaccaacgattccacgtcgacagaatttttcctggtagggctttctgcccacccaaagctccagacagttttcttcgttctaattttgtggatgtacctgatgatcctgcttggaaatggagtccttatctcagttatcatctttgattctcacctgcacacccccatgtatttcttcctctgtaatctttccttcctcgacgtttgctacacaagttcctctgtcccactaattcttgccagctttctggcagtaaagaaaaaggtttccttctctgggtgtatggtgcaaatgtttatttcttttgccatgggggccacggagtgcatgatcttaggcacgatggcactggaccgctatgtggccatctgctacccactgagataccctgtcatcatgagcaagggtgcctatgtggccatggcagctgggtcctgggtcactgggcttgtggactcagtagtgcagacagcttttgcaatgcagttaccattctgtgctaataatgtcattaaacattttgtctgtgaaattctggctatcttgaaactggcctgtgctgatatttcaatcaatgtgattagtatgacagggtcgaatctgattgttctggttattccattgttagtaatttccatctcttacatatttattgttgccactattctgaggattccttccactgaaggaaaacataaggccttctccacctgctcagcccacctgacagtggtgattatattctatggaaccatcttcttcatgtacgcaaagcctgagtctaaagcctctgttgattcaggtaatgaagacatcattgaggccctcatctcccttttctatggagtgatgactcccatgcttaatcctctcatctatagtctgcgaaacaaggatgtaaaggctgctgtcaaaaacatactgtgtaggaaaaacttttctgatggaaaatga

SEQ ID NO: 4317 - DNA, 957 bp, Homo sapiens
atggaatgggaaaaccaaaccattctggtggaattttttctgaagggacattctgttcacccaaggcttgagttactcttttttgtgctaatcttcataatgtatgtggtcatccttctggggaatggtactctcattttaatcagcatcttggaccctcaccttcacacccctatgtacttctttctggggaacctctccttcttggacatctgctacaccaccacctctattccctccacactagtgagcttcctttcagaaagaaagaccatttccttttctggctgtgcagtgcagatgttccttggcttggccatggggacaacagagtgtgtgcttctgggcatgatggcctttgaccgctatgtggctatctgcaaccctctgagatatcccatcatcatgagcaagaatgcctatgtacccatggctgttgggtcctggtttgcagggattgtcaactctgcagtacaaactacatttgtagtacaattgcctttctgcaggaagaatgtcatcaatcatttctcatgtgaaattctagctgtcatgaagttggcctgtgctgacatctcaggcaatgagttcctcatgcttgtggccacaatattgttcacattgatgccactgctcttgatagttatctcttactcattaatcatttccagcatcctcaagattcactcctctgaggggagaagcaaagctttctctacctgctcagcccatctgactgtggtcataatattctatgggaccatcctcttcatgtatatgaagcccaagtctaaagagacacttaattcagatgacttggatgctaccgacaaaattatatccatgttctatggggtgatgactcccatgatgaatcctttaatctacagtcttagaaacaaggatgtgaaagaggcagtaaaacacctaccgaacagaaggttctttagcaagtga

SEQ ID NO: 4318 - DNA, 1107 bp, Homo sapiens
tcaaacacaatatcggaagcaaatttgtattgaaaatttgtagatgtacagatttacagattttgatgtatcaaacatttcaatttacctgaatcatgtccttttctatactacccagcaggcaggtgacctagaacacatggagacaagaaattactctgccatgactgaattctttctggtggggctttcccaatatccagagctccagctttttctgttcctgctctgcctcatcatgtacatgataatcctcctgggaaatagcctcctcattatcatcaccatcttggattctcgcctccatactcccatgtatttctttcttggaaacctctcattcttggacatctgttacacatcctcatccattcctccaatgcttattatatttatgtctgagagaaaatccatctccttcattggctgtgctctgcagatggttgtgtcccttggcttgggctccactgagtgtgtcctcctggctgtgatggcctatgaccactatgtggccatctgcaacccactgaggtactccatcatcatgaacggagtgctgtatgtgcaaatggctgcatggtcctggatcataggctgtctgacctccctattgcaaacagttctgacaatgatgttgcctttctgtgggaataatgtcattgatcatattacctgtgaaattttggcccttctaaaacttgtttgttcagatatcaccatcaatgtgcttatcatgacagtgacaaatattgtttcactggtgattcttctactgttaattttcatctcctatgtgtttattctctcttccatcctgagaattaattgtgctgagggaagaaagaaagccttctctacctgttcagcgcactcgattgtggtcatcttattctacggttcagccctttttatgtacatgaaacccaagtcaaagaacactaatacatctgatgagattattgggctgtcttatggagtggtaagcccaatgttaaatcccatcatctatagcctcaggaataaagaggtcaaagaggctgtaaagaaagtcctgagcagacatctgcatttattgaaaatgtgaaaaaccttgggcatgcgatatcc

SEQ ID NO: 4319 - DNA, 1093 bp, Homo sapiens
gccagatatgtgaaggagggggttatgttttatatatgtgtgacgttaatccttctatgcatacgtacaggtgaacataacataaaaaaatgttcccggcaaattggacatctgtaaaagtatttttcttcctgggattttttcactaccccaaagttcaggtcatcatatttgcggtgtgcttgctgatgtacctgatcaccttgctgggcaacatttttctgatctccatcaccattctagattcccacctgcacacccctatgtacctcttcctcagcaatctctcctttctggacatctggtactcctcttctgccctctctccaatgctggcaaactttgtttcagggagaaacactatttcattctcagggtgcgccactcagatgtacctctcccttgccatgggctccactgagtgtgtgctcctgcccatgatggcatatgaccggtatgtggccatctgcaaccccctgagataccctgtcatcatgaataggagaacctgtgtgcagattgcagctggctcctggatgacaggctgtctcactgccatggtggaaatgatgtctgtgctgccactgtctctctgtggtaatagcatcatcaatcatttcacttgtgaaattctggccatcttgaaattggtttgtgtggacacctccctggtgcagttaatcatgctggtgatcagtgtacttcttctccccatgccaatgctactcatttgtatctcttatgcatttatcctcgccagtatcctgagaatcagctcagtggaaggtcgaagtaaagccttttcaacgtgcacagcccacctgatggtggtagttttgttctatgggacggctctctccatgcacctgaagccctccgctgtagattcacaggaaatagacaaatttatggctttggtgtatgccggacaaacccccatgttgaatcctatcatctatagtctacggaacaaagaggtgaaagtggccttgaaaaaattgctgattagaaatcattttaatactgccttcatttccatcctcaaataacaatcacactcatatagataatcaacattacccagaaaactgca

SEQ ID NO: 4320 - DNA, 1081 bp, Homo sapiens
tccacctttctcacaccctccatctttattcccattctttcaggtaacactaagtagccaattggcatccatttaatgaatagtggcaagagggaaagatggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtatgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttgaaaaggacatgagccttctttgcttctaaacgtctaaaataacacaacgtccctgatggagaaaatgg

SEQ ID NO: 4321 - DNA, 1087 bp, Homo sapiens
ccgcaccctgtaccctctctccttccatcccagctgtggaccatctcttcagaactctgcagcatggagccgctcaacagaacagaggtgtccgagttctttctgaaaggattttctggctacccagccctggagcatctgctcttccctctgtgctcagccatgtacctggtgaccctcctggggaacacagccatcatggcggtgagcgtgctagatatccacctgcacacgcccgtgtacttcttcctgggcaacctctctaccctggacatctgctacacgcccacctttgtgcctctgatgctggtccacctcctgtcatcccggaagaccatctcctttgctgtctgtgccatccagatgtgtctgagcctgtccacgggctccacggagtgcctgctactggccatcacggcctatgaccgctacctggccatctgccagccactcaggtaccacgtgctcatgagccaccggctctgcgtgctgctgatgggagctgcctgggtcctctgcctcctcaagtcggtgactgagatggtcatctccatgaggctgcccttctgtggccaccacgtggtcagtcacttcacctgcaagatcctggcagtgctgaagctggcatgcggcaacacgtcggtcagcgaagacttcctgctggcgggctccatcctgctgctgcctgtacccctggcattcatctgcctgtcctacttgctcatcctggccaccatcctgagggtgccctcggccgccaggtgctgcaaagccttctccacctgcttggcacacctggctgtagtgctgcttttctacggcaccatcatcttcatgtacttgaagcccaagagtaaggaagcccacatctctgatgaggtcttcacagtcctctatgccatggtcacgaccatgctgaaccccaccatctacagcctgaggaacaaggaggtgaaggaggccgccaggaaggtgtggggcaggagtcgggcctccaggtgagggagggcggggctctgtacagacgcaggtctcaggttagtagctgaggccatcgtatgccaatgccagtgaagacatggcaggg

SEQ ID NO: 4322 - DNA, 930 bp, Homo sapiens
atggcaaatctcacaatcgtgactgaatttatccttatggggttttctaccaataaaaatatgtgcattttgcattcgattctcttcttgttgatttatttgtgtgccctgatggggaatgtcctcattatcatgatcacaactttggaccatcatctccacacccccgtgtatttcttcttgaagaatctatctttcttggatctctgccttatttcagtcacggctcccaaatctatcgccaattctttgatacacaacaactccatttcattccttggctgtgtttcccaggtctttttgttgctttcttcagcatctgcagagctgctcctcctcacggtgatgtcctttgaccgctatactgctatatgtcaccctctgcactatgatgtcatcatggacaggagcacctgtgtccaaagagccactgtgtcttggctgtatgggggtctgattgctgtgatgcacacagctggcaccttctccttatcctactgtgggtccaacatggtccatcagttcttctgtgacattccccagttattagctatttcttgctcagaaaatttaataagagaaattgcactcatccttattaatgtagttttggatttctgctgttttattgtcatcatcattacctatgtccacgtcttctctacagtcaagaagatcccttccacagaaggccagtcaaaagcctactctatttgccttccacacttgctggttgtgttatttctttccactggattcattgcttatctgaagccagcttcagagtctccttctattttggatgctgtaatttctgtgttctacactatgctgcccccaacctttaatcccattatatacagtttgagaaacaaggccataaaggtggctctggggatgttgataaagggaaagctcaccaaaaagtaa

SEQ ID NO: 4323 - DNA, 945 bp, Homo sapiens
atggccaatgtcaccttggtgacaggatttcttcttatggggttttctaatatccagaagctgcggattttatatggtgtgctcttcctactgatttacctggcagccctaatgagtaaccttctcatcattactctcattaccctggacgtaaagctccaaacacccatgtacttcttcctgaagaacttatcctttttggatgtcttcctggtgtctgttccaatcccaaaattcattgtcaacaacctaacccacaacaattccatttccattctaggatgtgccttccagctacttttaatgacttccttctcagcaggagagatatttatcctcactgccatgtcctatgaccgctatgtagccatctgctgtcccctgaactacgaggtaatcatgaatactggagtctgtgtgttaatggcaagtgtttcctgggccattggagggctctttggtactgcgtacacagctggcacattttccatgcctttctgtggctccagtgtgattccacagtttttctgtgatgttccttcattactaaggatttcctgttctgaaacactaatggtaatttatgcaggtattggagttggtgcatgtttaagcatttcttgtttcatctgtattgtgatctcttacatttatatcttctccactgtactgaagatccctaccactaaaggtcagtccaaagctttttccacatgcttcccccatctcactgttttcactgtttttatcataactgcttattttgtttatcttaagccaccttcaaattcaccatctgttattgacaggctgctttctgtgatctacactgtgatgcctccagtatttaaccctgtaacctacagcctgcggaacaatgacatgaaatgtgctctgataaggttgctgcagaaaacatatggtcaggaggcttacttcatttaa

SEQ ID NO: 4324 - DNA, 939 bp, Homo sapiens
atgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaa

SEQ ID NO: 4325 - DNA, 1117 bp, Homo sapiens
gcattttcttcctactgtctttggcttcctaaacagagtcacacttggtatcttcagagagactatggtcaatttgacttcaatgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctgaagaaccatacaaatgaaaggcattgttattatgtttcagattggaagagaggtgaatcttatttctacccagaatgctcttccaagc

SEQ ID NO: 4326 - DNA, 1117 bp, Homo sapiens; identical to SEQ ID NO: 4325

SEQ ID NO: 4327 - DNA, 1117 bp, Homo sapiens; identical to SEQ ID NO: 4325

SEQ ID NO: 4328 - DNA, 945 bp, Homo sapiens
atgaccaatcagacacagatgatggaattcttgcttgtgagatttactgagaattgggtgctcctgaggctgcatgctttgctcttctcactgatctacctcacggctgtgctgatgaatttagtcatcattctcctcatgattctggaccatcgtctccacatggcaatgtactttttcctccgacatttgtccttcttagacctgtgtctcatttctgccacagtccccaaatccatcctcaactctgtcgcctccactgactccatctccttcctggggtgtgtgttgcagctcttcttggtggtactgctggctggatcagagattggcatccttactgccatgtcctatgaccgctatgctgccatctgctgccccctacactgtgaggctgtcatgagcagagggctctgtgtccagttgatggctctgtcctggctcaacagaggggccttgggactcttgtacacagctggaacattctctctgaatttttatggctctgatgagctacatcagttcttctgcgatgtccctgccctactaaagctcacttgttctaaagaacatgccatcattagtgtcagtgtggccattggggtctgttatgcattttcatgtttagtttgcattgtagtttcctatgtgtacattttctctgctgtgttaaggatatcacagagacagagacaatccaaagccttttccaactgtgtgcctcacctcattgttgtcactgtgtttcttgtaacaggtgctgttgcttatttaaagccagggtctgatgcaccttctattctagacttgctggtgtctgtgttctattctgtcgcacctccaaccttgaaccctgttatctactgtctgaagaacaaggacattaaatccgctctgagtaaagtcctgtggaatgttagaagcagtggggtaatgaaaagatga

SEQ ID NO: 4329 - DNA, 933 bp, Homo sapiens
atgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggctgcatgacgcagacctttctctgtttgagttttggacacagcgaatgtctcctgctggtgctgatgtcctacgatcgttacgtggccatctgccaccctctccgatactccgtcatcatgacctggagagtctgcatcaccctggccgtcacttcctggacgtgtggctccctcctggctctggcccatgtggttctcatcctaagactgcccttctctgggcctcatgaaatcaaccacttcttctgtgaaatcctgtctgtcctcaggctggcctgtgctgacacctggctcaaccaggtggtcatctttgcagcctgcgtgttcttcctggtggggccacccagcctggtgcttgtctcctactcgcacatcctggcggccatcctgaggatccagtctggggagggccgcagaaaggccttctccacctgctcctcccacctctgcgtggtgggactcttctttggcagtgccatcatcatgtacatggcccccaagtcccgccatcctgaggagcagcaaaaggtcttttttctattttacagttttttcaacccaacacttaaccccctgatttacagcctgaggaacggagaggtcaagggtgccctgaggagagcactgggcaaggaaagtcattcctaa

SEQ ID NO: 4330 - DNA, 1046 bp, Homo sapiens
tcccattagctgtgaaatttctgtcttaagtacatcacaagatttttctgtcacgagaacatggaaagcaatcagacctggatcacagaagtcatcctgttgggattccaggtggacccagctctggagttgttcctctttgggtttttcttgctattctacagcttaaccctgatgggaaatgggattatcctggggctcatctacttggactctagactgcacacacccatgtatgtcttcctgtcacacctggccattgtggacatgtcctatgcctcgagtactgtccctaagatgctagcaaatcttgtgatgcacaaaaaagtcatctcctttgctccttgcatacttcagacttttttgtatttggcgtttgctattacagagtgtctgattttggtgatgatgtgctatgatcggtatgtggcaatctgtcaccccttgcaatacaccctcattatgaactggagagtgtgcactgtcctggcctcaacttgctggatatttagctttctcttggctctggtccatattactcttattctgaggctgcctttttgtggcccacaaaagatcaaccactttttctgtcaaatcatgtccgtattcaaattggcctgtgctgacactaggctcaaccaggtggtcctatttgcgggttctgcgttcatcttagtggggccgctctgcctggtgctggtctcctacttgcacatcctggtggccatcttgaggatccagtctggggagggccgcagaaaggccttctctacctgctcctcccacctctgcgtggtggggcttttctttggcagcgccattgtcatgtacatggcccccaagtcaagccattctcaagaacggaggaagatcctttccctgttttacagccttttcaacccgatcctgaaccccctcatctacagccttaggaatgcagaggtgaaaggggctctaaagagagtcctttggaaacagagatcaatgtgaagaatcatttgagatatcctgagtgtgtaagcatggttctcatgaccctgggt

SEQ ID NO: 4331 - DNA, 1012 bp, Homo sapiens
gcatctttgactggcccacagctctgaccttcctgtcctagatgtccacaagagcatggaaggcaacaagacatggatcacagacatcaccttgccgcgattccaggttggtccagcactggagattctcctctgtggacttttctctgccttctatacactcaccctgctggggaatggggtcatctttgggattatctgcctggactgtaagcttcacacacccatgtacttcttcctctcacacctggccattgttgacatatcctatgcttccaactatgtccccaagatgctgacgaatcttatgaaccaggaaagcaccatctccttttttccatgcataatgcagacattcttgtatttggcttttgctcacgtagagtgtctgattttggtggtgatgtcctatgatcgctatgcggacatctgccaccccttacgttacaatagcctcatgagctggagagtgtgcactgtcctggctgtggcttcctgggtgttcagcttcctcctggctctggtccctttagttctcatcctgagcctgcccttctgcgggcctcatgaaatcaaccacttcttctgtgaaatcctgtctgtcctcaagttggcctgtgctgacacctggctcaaccaggtggtcatctttgcagcctgcgtgttcatcctggtggggccactctgcctggtgctggtctcctacttgcgcatcctggccgccatcttgaggatccagtctggggagggccgcagaaaggccttctccacctgctcctcccacctttgcgtggtgggactcttctttggcagcgccattgtcacgtacatggcccccaagtcccgccatcctgaggagcagcagaaagttctttccctgttttacagccttttcaatccaatgctgaaccccctgatatatagcctaaggaatgcagaggtcaagggcgccctgaggagggcactgaggaaggagaggctgacgtgagacatctcaaagggaaccatgggg

SEQ ID NO: 4332 - DNA, 1051 bp, Homo sapiens
tgcatctttgacccacagctctgaccttcctgtcctagatgagggtttgtctttctctgccacaagagcatggaaggcaaccagacatggatcacagacatcaccctgctgggattccaggttggtccagcactggcgattctcctctgtggactcttctctgtcttctatacactcaccctgctggggaatggggtcatctttgggattatctgcctggactctaagcttcacacacccatgtacttcttcctctcacacctggccatcattgacatgtcctatgcttccaacaatgttcccaagatgttggcaaacctaatgaaccagaaaagaaccatctcctttgttccatgcataatgcagacttttttgtatttggcttttgctgttacagagtgcctgattttggtggtgatgtcctatgataggtatgtggccatctgccaccctttccagtacactgtcatcatgagctggagagtgtgcacgatcctggttctcacgtcctggtcatgtgggtttgccctgtccctggtacatgaaattctccttctaaggttgcccttctgtgggccccgggatgtgaaccacctcttctgtgaaattctgtctgtcctcaagctggcctgtgctgacacctgggttaaccaagtggtcatatttgctacctgtgtgtttgtcttagtcgggcctctttccttgattctggtctcctacatgcacatcctcggggccatcctgaagatccagacaaaggagggccgcataaaggccttctccacctgctcctcccacctgtgtgtggttggactattctttggcatagccatggtggtttacatggtcccagactctaatcaacgagaggagcaggagaaaatgctgtccctgtttcacagtgtctttaatccaatgctgaaccccctgatctacagcctgaggaatgctcagttgaagggcgccctccacagagcactccagaggaagaggtccatgagaacggtgtatgggctttgcctttaaaacatgtggtttgctgaagcaagaa

SEQ ID NO: 4333 - DNA, 1014 bp, Homo sapiens
ttcagacttggtgagctccttgtttcttctacagggaaatggggggaaatcagacttccatcacagagttcctcctactgggatttcccattggcccaaggattcagatgctcctctttgggctcttctccctgttctacatcttcattctgttggggaacgggacaatcctggggctcatctcactggactccagactccacacccccatgtacttcttcctctcacacctggcggtcgtcgacatcgcctgtgcttgcagcacggtgccccagatgctggtgaacctcctgcatccagccaagcccatctcctttgctggctgcatgacccagatgtttctgtttttgagttttgcacatacagaatgtctcctcctggtggtgatgtcctatgatcggtacgtggccatctgccaccctctccgatattctaccatcatgacctggaaagtctgcatcactttggcattgacttcctggattttaggagtcttattggcccttgtccatctagtgttactgctaccactgtccttctgtggaccccagaaacttaatcactttttctgtgaaattatggctgttctcaaacttgcctgtgcggatacccacattaatgaggtaatggttttggcaggggcagtgtctgtgctggtgggagccttcttttccactgtaatatcttatgttcatattctatgtgccattctaaagatccagtcaggagaggggtgccagaaagccttctccatctgctcctcccacctctgtgtggttggactcttttatggcacagccatcatcatgtatgttgagccccagtatgagagccccaaggagcagaagaaatatctcctgctgtttcacagcctcttcaatcccatgcttaatcccctaatttatagtcttaggaacaaggaagtccaaggtactctaaagaggatgcttgaaaagaagagaacttcatgaaagcctgaaagaatagtaaaatagctggcttcaaagggctttg

SEQ ID NO: 4334 - DNA, 1116 bp, Homo sapiens
tcaccaaagagtgccgaacaagttaaaatgaatctgtttttaaacacttctcctaaaccatgagcattaacttgatttcctctgtcatagggatatgggagacaatataacatccatcagagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttccgcacctgcttctcccacctctgtgtgattggactcgtttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatgaaaaggattatggcattgtgactgacagtgacctaggaagttacatcattgagcggttcttaacccatctctgcactggtgggacctctg

SEQ ID NO: 4335 - DNA, 933 bp, Homo sapiens
atgggggaaaatcagacaatggtcacagagttcctcctactgggatttctcctgggcccaaggattcagatgctcctctttgggctcttctccctgttctatatcttcaccctgctggggaacggggccatcctggggctcatctcactggactccagactccacacccccatgtacttcttcctctcacacctggctgtcgtcgacatcgcctacacccgcaacacggtgccccagatgctggcgaacctcctgcatccagccaagcccatctcctttgctggttgcatgacgcagacctttctctgtttgagttttggacacagcgaatgtctcctgctggtgctgatgtcctacgatcgttacgtggccatctgccaccctctccgatactccgtcatcatgacctggagagtctgcatcaccctggccgtcacttcctggacgtgtggctccctcctggctctggcccatgtggttctcatcctaagactgcccttctctgggcctcatgaaatcaaccacttcttctgtgaaatcctgtctgtcctcaggctggcctgtgctgacacctggctcaaccaggtggtcatctttgcagcctgcgtgttcttcctggtggggccacccagcctggtgcttgtctcctactcgcacatcctggcggccatcctgaggatccagtctggggagggccgcagaaaggccttctccacctgctcctcccacctctgcgtggtgggactcttctttggcagtgccatcatcatgtacatggcccccaagtcccgccatcctgaggagcagcaaaaggtcttttttctattttacagttttttcaacccaacacttaaccccctgatttacagcctgaggaacggagaggtcaagggtgccctgaggagagcactgggcaaggaaagtcattcctaa

SEQ ID NO: 4336 - DNA, 1013 bp, Homo sapiens
cagcagagtccaacgcaggtactgtcacaagggcatgacaaaaaatcagacatgggtcacagaattcattctcctgggatttccactcagcctaaggattcagatgctcctctctgggcttttctccctgttatacgtcttcaccctgctgggaaatggggccatcctggggctcatctggctggactccagactgcacacccccatgtacttctttctctcacacctggccatcattgatatttcgtatgcttccaacaatgtccccaagatgctgacaaaccttggcttgaacaagagaaaaacaatctcctttgtcccatgcacaatgcagacctttttatacatggcttttgctcacactgagtgtctcatcttggtaatgatgtcctacgatcggtacatggctatctgccaccctctgcaatattctgtcatcatgagatggggagtgtgcacagtcctggctgtcacttcttgggcatgtggttcccttctggccctggtccatgtggttctcatcctgaggctgcccttctgtgggccccatgaaatcaaccacttcttctgtgaaatcctgtctgtcctcaagttggcctgtgctgacacctggctcaaccaggtggtcatctttgctgcttcagtgttcatcctggtggggccgctctgcctggtgctggtctcctactcgcgcatcctggcggccatcttgaggatccagtctggggagggccgcagaaaggccttctccacctgctcctcccacctttgcatggtgggactcttctttggcagcgccattgtcatgtacatggcccccaagtcccgccaccctgaggagcagcagaaggtcctttccctgttttacagccttttcaacccgatgctgaaccccttgatctatagcctgaggaacgcagaggtcaagggtgccctgaaaagagtgttgtggaaacagagatcaaagtgagggatgccagggaaagtctagagggttgaagatttgctcccaa

SEQ ID NO: 4337 - DNA, 1116 bp, Homo sapiens
tcaccaaagagtgccgaacaagttaaaatgaatctgtttttaaacacttctcctaaaccatgagcattaacttgatttcctctgtcatagggatatgggggacaatataacatccatcacagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttctgcacctgcttctcccacctctgtgtgattggactcttttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatgaaaaggattatggcattgtgactgacagtgacctaggaagttacatcattgagcggttcttaacccatctctgcactggtgggacctctg

SEQ ID NO: 4338 - DNA, 1071 bp, Homo sapiens
cctcagggattgagaaaggggacaatgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccaatgtatttcctgctcagccagctctccctcatggatctgatgcatgtctccacaatcatcctgaagatggctaccaactacctatctggcaagaaatctatctcctttgtgggctgtgcaacccagcacttcctctatttgtgtctaggtggtgctgaatgttttctcttagctgtcatgtcctatgaccgctatgttgccatctgtcatccactgcgctatgctgtgctcatgaacaagaaggtgggactgatgatggctgtcatgtcatggttgggggcatccgtgaactccctaattcacatggcgatcttgatgcacttccctttctgtgggcctcggaaagtctaccacttctactgtgagttcccagctgttgtgaagttggtatgtggcgacatcactgtgtatgagaccacagtgtacatcagcagcattctcctcctcctccccatcttcctgatttctacatcctatgtcttcatccttcaaagtgtcattcagatgcgctcatctgggagcaagagaaatgcctttgccacttgtggctcccacctcacggtggtttctctttggtttggtgcctgcatcttctcctacatgagacccaggtcccagtgcactctattgcagaacaaagttggttctgtgttctacagcatcattacgcccacattgaattctctgatttatactctccggaataaagatgtagctaaggctctgagaagagtgctgaggagagatgttatcacccagtgcattcaacgactgcaattgtggttgccccgagtgtagagtggaataggataagctccttaaattaattcatataaacctctaaagtttttcagggagatagcttccttatgc

SEQ ID NO: 4339 - DNA, 998 bp, Homo sapiens
ggtgatgaaagaaaccacagcatggagctctggaacttcaccttgggaagtggcttcattttggtggggattctgaatgacagtgggtctcctgaactgctctgtgctacaattacaatcctatacttgttggccctgatcagcaatggcctactgctcctggctatcaccatggaagcccggctccacatgcccatgtacctcctgcttgggcagctctctctcatggacctcctgttcacatctgttgtcactcccaaggcccttgcggactttctgcgcagagaaaacaccatctcctttggaggctgtgcccttcagatgttcctggcactgacaatgggtggtgctgaggacctcctactggccttcatggcctatgacaggtatgtggccatttgtcatcctctgacatacatgaccctcatgagctcaagagcctgctggctcatggtggccacgtcctggatcctggcatccctaagtgccctaatatataccgtgtataccatgcactatcccttctgcagggcccaggagatcaggcatcttctctgtgagatcccacacttgctgaaggtggcctgtgctgatacctccagatatgagctcatggtatatgtgatgggtgtgaccttcctgattccctctcttgctgctatactggcctcctatacacaaattctactcactgtgctccatatgccatcaaatgaggggaggaagaaagcccttgtcacctgctcttcccacctgactgtggttgggatgttctatggagctgccacattcatgtatgtcttgcccagttccttccacagcaccagacaagacaacatcatctctgttttctacacaattgtcactccagccctgaatccactcatctacagcctgaggaataaggaggtcatgcgggccttgaggagggtcctgggaaaatacatgctgccagcacactccacgctctagggaaggatcatggctagcttccagaa

SEQ ID NO: 4340 - DNA, 987 bp, Homo sapiens
atgggccatcagaatcacactttcagcagtgatttcatacttttgggattgttctcttcttccccaacaagtgtggtcttcttcttagttttatttgtcattttcattatgagtgtaacagaaaatacgctcatgatcctcctcattcgcagtgactcccgactccacactccaatgtattttctgctcagccatctctccttaatggatatcttgcatgtttccaacatcgttcccaaaatggtcactaactttctgtcaggcagcagaactatttcatttgcaggttgtgggttccaggtatttctgtccctcaccctcctgggtggtgagtgccttctcctggctgcaatgtcctgtgatcgctatgtggctatctgtcacccgctgcgctatccgattcttatgaaggagtatgccagcgctctcatggctggaggctcctggctcattggggttttcaactccacagtccacacagcttatgcactgcagtttcccttctgtggctctagggcaattgatcacttcttctgtgaagtccctgccatgttgaagttgtcctgtgcagacacaacacgctatgaacgaggggtttgtgtaagtgctgtgatcttcctgctgatccctttctccttgatctctgcttcttatggccaaattattcttactgtcctccagatgaaatcatcagaggcaaggaaaaagtcattttccacttgttccttccacatgattgtggtcacgatgtactatgggccatttatttttacatatatgagacctaaatcataccacactccaggccaggataagttcctggcaatattctatacgatcctcacacccacactcaaccctttcatctacagctttaggaataaagatgttctggcggtgatgaaaaatatgctcaaaagtaactttctgcacaaaaaaatgaataggaaaattcctgaatgtgtgttctgtctatttctatgttaa

SEQ ID NO: 4341 - DNA, 1107 bp, Homo sapiens
tgctctaaacatgtagatagttgccaaacatgtaagtgaatatttatttctgaatgccatgtcattttactttctcttaagggaagtcaacattattacatgaacatttcagatgtcatctcctttgatattttggtttcagccatgaaaacaggaaatcaaagttttgggacagattttctacttgttggtcttttccaatatggctggataaactctcttctctttgtcgtcattgccaccctctttacagttgctctgacaggaaatatcatgctgatccacctcattcgactgaacaccagactccacactccaatgtactttctgctcagtcagctctccatcgttgacctcatgtacatctccaccacagtgcccaagatggcagtcagcttcctctcacagagtaagaccattagatttttgggctgtgagattcaaacgtatgtgttcttggcccttggtggaactgaagcccttctccttggttttatgtcttatgatcgctatgtagctatctgtcaccctttacattatcctatgcttatgagcaagaagatctgctgcctcatggttgcatgtgcatgggccagtggttctatcaatgctttcatacatacattgtatgtgtttcagcttccattctgtaggtctcggctcattaaccactttttctgtgaagttccagctctactatcattggtgtgtcaggacacctcccagtatgagtatacagtcctcctgagtggacttattatcttgctactaccattcctagccattctggcttcctatgctcgtgtgcttattgtggtattccagatgagctcaggaaaaggacaggcaaaagctgtttccacttgttcctcccacctgattgtggcaagcctgttctatgcaaccactctctttacctacacaaggccacactccttgcgttccccttcacgggataaggcggtggcagtattttacaccattgtcacacctctactgaacccatttatctacagcctgagaaataaggaagtgacgggggcagtgaggagactgttgggatattggatatgctgtagaaaatatgacttcagatctctgtattga

SEQ ID NO: 4342 - DNA, 930 bp, Homo sapiens
atgaaaaataaaaccgtgttaactgagtttatccttctgggtctaacagatgtccctgaactccaggtggcagttttcacctttcttttccttgcgtatttactcagcatccttggaaatctgactatcctcatcctcaccttgctggactcccaccttcagactcccatgtatttctttctccggaacttctccttcttggaaatttccttcacaaacatcttcattccaagggtcctgattagcatcacaacagggaacaagagtatcagctttgctggctgcttcactcagtatttctttgccatgttccttggggctacagagttttaccttctggctgccatgtcctatgaccgctatgtggccatctgcaaacctctgcattacaccaccatcatgagcagcagaatctgcatccagctgattttctgctcttggctgggtgggctaatggctattataccaacaatcaccctgatgagtcagcaggacttttgtgcatccaacagactgaatcattacttctgtgactatgagcctcttctggaactctcatgttcagacacaagcctcatagagaaggttgtctttcttgtggcatctgtgaccctggtggtcactctggtgctagtgattctctcctatgcattcattatcaagactattctgaagctcccctctgcccaacaaaggacaaaagccttttccacatgttcttcccacatgattgtcatctccctctcttacggaagctgcatgtttatgtacattaatccctctgcaaaagaaggggatacattcaacaagggagtagctctactcattacttcagttgctcctttgttgaacccctttatttacaccctaaggaaccaacaggtaaaacaacccttcaaggatatggtcaaaaagcttctgaatctttaa

SEQ ID NO: 4343 - DNA, 1042 bp, Homo sapiens
ttccagctgcccatctctgagaaatccagctgtgtctcacaatggatgccacagcctgtaatgaatcagtggatggctcacccgtcttctatctattgggcatcccctctctgccagagaccttcttcctccctgtgttttttattttcctcctcttctaccttctcatcctgatgggtaatgccctgatcctggtggccgtggtggcagagcccagcctccacaagcccatgtacttctttctgatcaatctctccaccttggacatccttttcaccacaaccactgtccccaagatgctgtccttattcttgcttggggaccgcttcctcagcttttcttcctgcttactgcagatgtacctcttccaaagttttacatgttcagaagccttcatcctggtggtcatggcctatgaccgctatgtggctatctgccacccactgcactaccctgtcctcatgaacccacagaccaatgctaccttggcagccagtgcctggctaactgccctcctcctgcccatcccagcagtagtaaggacctcccagatggcatataacagcattgcctacatctaccactgcttctgtgatcatctggctgtggtccaggcctcctgctctgacaccaccccccagaccctcatgggcttctgcatcgccatggtggtgtccttcctcccccttctcctggtgcttctctcctatgtccacatcctggcctcagtgcttcgcatcagttccctagaaggacgggcaaaagccttctccacctgcagctcccaccttctggtcgtgggcacctactactcatctattgccatagcctacgtggcctacagggctgacctgccccttgacttccatatcatgggcaatgtggtatatgccattctcacaccaattctcaaccccctcatttacacgctgagaaacagggatgtaaaggcagccatcaccaaaatcatgtctcaagacccaggctgtgacaggagcatttgacctttaaatgcagctaactctgcttccaggacaccaaa

SEQ ID NO: 4344 - DNA, 1054 bp, Homo sapiens
acaagtgccagaaaatgccgcaacatgaaaagtgacaaccatagcttcttaggggactcccctaaagccttcatccttctgggtgtgtctgacaggccgtggctggaactccctctctttgtggtcctcctgctgtcctatgtgctggccatgttggggaacgtcgccatcatcctggcatcccgggtggatcctcaactccacagccccatgtacatcttcctcagtcacctgtccttcctggacctctgctacaccaccacgacagtccctcagatgctggtcaacatgggcagttcccagaagaccatcagctatggaggctgcactgtgcaatatgcagtcttccactggctgggatgcacggagtgcatcgtcctggccgccatggccctggaccgctacgtggccatctgcaagcccctgcactatgccgttctcatgcaccgtgctctctgtcagcagctcgtggctctggcctggctcagtggcttcggcaactccttcgtgcaggtggtcctgacggtgcaattgccattctgcgggcggcaggtgctgaacaactttttctgtgaggtgccggccgtgatcaagctgtcgtgtgctgacaccgctgtgaatgacaccatactggctgtgctggtggccttcttcgtgttggtgcccctggctctcatccttctctcctatggctttattgcccgggcagtgctcaggatccagtcctccaagggacgacacaaggcctttgggacgtgttcctcccacctgatgatcgtctccctcttctacctacctgcgatttacatgtatctgcagcccccttccagctactcccaagagcagggcaaatttatttctctcttctattccataatcacccccactctcaatcccttcacctacaccctgagaaataaagatatgaagggggctctgaggagacttctggccaggatctggaggctctgtggatgatgaggacatgagatgtagcatctccatcaattaaagaacacagcacaagtctattgtgcactcagagcatctttca

SEQ ID NO: 4345 - DNA, 1212 bp, Homo sapiens
gctgacaaaatcaggaagtgtgttgttaacttcctgacttcttatatttcagagaacgaagagttgaaccatttaacatgaattgggtaaataagagtgtcccacaggagttcattctgttagttttctcagatcaaccatggctagagattccaccctttgtgatgtttctgttttcctatatcttgacaatctttggcaatctgacaataattcttgtgtcacatgtggatttcaaactccacacccctatgtacttttttcttagcaatctctcactcctggacctttgctataccacaagtacagttccacaaatgctggtaaacatatgcaacaccaggaaagtaatcagttatggtggctgtgtggcccagcttttcattttcctggccttgggttccacagaatgtcttctcctggccgtcatgtgctttgataggtttgtagctatttgtcggcctctccattactcaattatcatgcaccagaggctctgcttccagttggcagctgcatcctggattagtggctttagcaattcagtattacagtccacctggacacttaagatgccactgtgtggtcacaaagaagtggatcacttcttctgtgaagtccctgctctgctcaagttgtcctgtgttgacacaacagcaaatgaggctgaactattcttcatcagtgtgctattccttctaatacccgtgacactcatccttatatcgtatgcttttattgtccaagcagtgttgagaatccagtctgctgaaggtcaacgaaaggcatttgggacatgtggctcccatctaattgtggtgtcacttttttatggtacagctatctccatgtacctgcaaccaccttcacccagctccaaagaccggggaaagatggtttctctcttctgtggaatcattgcacccatgctgaatccccttatatatacacttaggaacaaagaggtaaaggaagcctttaaaaggttggttgcaaagagtcttcttaatcaagaaataagaaatatgcaaatgataagctttgctaaagacacagtgcttacttaccttactaacttctccgcaagttgtcctatttttgtcattactatagaaaactattgtaatctccctcaaagaaaatttccttgacaaaaagctatatttgtttctgttgcctaaacattttcattgaacaagcccccagaattgg

SEQ ID NO: 4346 - DNA, 1106 bp, Homo sapiens
ataaacaaacattgattgctttcctatcttacatttttttaggagtgcgaaataagtgagtcatcatgaattgggaaaatgagagctccccaaaagagtttatactacttggcttctcagatagggcttggctacaaatgcccctttttgtggtcctgttaatatcatacacaatcaccatatttggcaatgtgtccatcatgatggtgtgcattctggatcccaaacttcatactcccatgtatttctttctcactaatctctccatcttagatctctgctataccacaactacagtccctcatatgttggtaaatattggttgcaacaaaaagaccatcagctatgctggctgtgtggcccacctcatcatcttcctggccctaggtgctacagagtgtctccttctggctgttatgtcctttgacagatatgtggctgtttgcagacccctccactatgtagtcatcatgaattattggttctgcctaaggatggcagccttctcatggctcattggtttcggcaactcagtgctgcagtcttccttgactcttaacatgccacgctgtggtcaccaggaagtggaccactttttctgtgaggtgcctgcacttctcaagttgtcatgtgctgacacaaagcctattgaggctgagctcttcttctttagtgtactaattcttctaattccagtgacattgatcctcatctcctatggcttcatagctcaagcagtattaaaaatcaggtcagcagaaggacggcaaaaagcatttgggacatgtgggtcccacatgattgtggtgtccctcttttatggaacagccatttatatgtatcttcaaccaccttcatccacctctaaggactggggaaagatggtttccctcttctatggaatcatcacatccatgttgaactccctcatctacagccttagaaataaagatatgaaggaggccttcaagaggctgatgccaagaatctttttctgtaagaaataagaagtactccattgtgatgagaatcttcttagtctttccttatcttcaatgatggtaatgacctttgaactcattttcctattttccaggctctggtga

SEQ ID NO: 4347 - DNA, 1106 bp, Homo sapiens; identical to SEQ ID NO: 4346

SEQ ID NO: 4348 - DNA, 1106 bp, Homo sapiens; identical to SEQ ID NO: 4346

SEQ ID NO: 4349 - DNA, 1106 bp, Homo sapiens; identical to SEQ ID NO: 4346

SEQ ID NO: 4350 - DNA, 1106 bp, Homo sapiens; identical to SEQ ID NO: 4346

SEQ ID NO: 4351 - DNA, 1106 bp, Homo sapiens; identical to SEQ ID NO: 4346

SEQ ID NO: 4352 - DNA, 1106 bp, Homo sapiens
ataaacaaacattgattgctttcctatcttacatttttttaggagtgcgaaataagtgagtcatcatgaattgggaaaatgagagctccccaaaagagtttatactacttggcttctcagatagggcttggctacaaatgcccctttttgtggtcctgttaatatcatacacaatcaccatatttggcaatgtgtccatcatgatggtgtgcattctggatcccaaacttcatactcccatgtatttctttctcactaatctctccatcttagatctctgctataccacaactacagtccctcatatgttggtaaatattggttgcaacaaaaagaccatcagctatgctggctgtgtggcccacctcatcatcttcctggccctaggtgctacagagtgtctccttctggctgttatgtcctttgacagatatgtggctgtttgcagacccctccactatgtagtcatcatgaattattggttctgcctaaggatggcagccttctcatggctcattggtttcggcaactcagtgctgcagtcttccttgactcttaacatgccacgctgtggtcaccaggaagtggaccactttttctgtgaggtgcctgcacttctcaagttgtcatgtgctgacacaaagcctattgaggctgagctcttcttctttagtgtactaattcttctaattccagtgacattgatcctcatctcctatggcttcatagctcaagcagtattaaaaatcaggtcagcagaaggacggcaaaaagcatttgggacatgtgggtcccacatgattgtggtgtccctcttttatggaacagccatttatatgtatcttcaaccaccttcatccacctctaaggactggggaaagatggtttccctcttctatggaatcatcacatccatgttgaactccctcatctacagccttagaaataaagatatgaaggaggccttcaagaggctgatgccaagaatctttttctgtaagaaataagaagtactccattgtgatgagaatcttcttagtctttccttatcttcaatgatggtaatgacctttgaactcattttcctatttttcaggctctggtga

SEQ ID NO: 4353 - DNA, 1106 bp, Homo sapiens; identical to SEQ ID NO: 4346

SEQ ID NO: 4354 - DNA, 942 bp, Homo sapiens
atgaattgggtaaatgacagcatcatacaggagtttattctgctgggtttctcagatcgaccttggctggagtttccactccttgtggtcttcttgatttcttacactgtgaccatctttggcaatctgaccattattctagtgtcacgcctggacaccaaacttcatacccccatgtatttttttcttaccaatctatcactcctggatctttgttacaccacatgtacagtcccacaaatgctagtaaatttatgcagcatcaggaaagtaatcagttatcgtggctgtgtagcccagcttttcatatttctggccttgggggctactgaatatcttctcctggccgtcatgtcctttgataggtttgtagctatttgtcggcctctccattactcagttatcatgcaccagagactctgcctccagttggcagctgcatcctgggttactggttttagtaactcagtgtggttgtctaccctgactctccagctgccactctgtgacccctatgtgatagatcactttctctgtgaagtccctgcactgctcaagttatcttgtgttgagacaacagcaaatgaggctgaactattccttgtcagtgagctcttccatctaatacccctgacactcatccttatatcatatgcttttattgtccgagcagtattgaggatacagtctgctgaaggtcgacaaaaagcatttgggacatgtggttcccatctaattgtggtgtctcttttttatagtacagccgtctctgtgtacctgcaaccaccttcgcccagctccaaggaccaaggaaagatggtttctctcttctatggaatcattgcacccatgctgaatccccttatatatacacttaggaacaaggaggtaaaggaaggctttaaaaggttggttgcaagagtcttcttaatcaagaaataa

SEQ ID NO: 4355 - DNA, 1036 bp, Homo sapiens
ttccagcagcttgcgctaaatgaattcatcaagtgactgaagacaaccagtgatggacggggtgaatgatagctccttgcagggctttgttctgatgggcatatcagaccatccccagctggagatgatcttttttatagccatcctcttctcctatttgctgaccctacttgggaactcaaccatcatcttgctttcccgcctggaggcccggctccatacacccatgtacttcttcctcagcaacctctcctccttggaccttgctttcgctactagttcagtcccccaaatgctgatcaatttatggggaccaggcaagaccatcagctatggtggctgcataacccagctctatgtcttcctttggctgggggccaccgagtgcatcctgctggtggtgatggcatttgaccgctacgtggcagtgtgccggcccctccgctacaccgccatcatgaacccccagctctgctggctgctggctgtgattgcctgcctgggtggcttgggcaactctgtgatccagtcaacattcactctgcagctcccattgtgtgggcaccggagggtggagggattcctctgcgaggtgcctgccatgatcaaactggcctgtggcgacacaagtctcaaccaggctgtgctcaatggtgtctgcaccttcttcactgcagtcccactaagcatcatcgtgatctcctactgcctcattgctcaggcagtgctgaaaatccgctctgcagaggggaggcgaaaggcgttcaatacgtgcctctcccatctgctggtggtgttcctcttctatggctcagccagctatgggtatctgcttccggccaagaacagcaaacaggaccagggcaagttcatttccctgttctactcgttggtcacacccatggtgaatcccctcatctacacgctgcggaacatggaagtgaagggcgcactgaggaggttgctggggaaaggaagagaagttggctgagagaacactccttcgttatttattgcgtcttcatctctacatgcg

SEQ ID NO: 4356 - DNA, 2742 bp, Homo sapiens
cagaaatcaactgacaaatggcagattcataggagaaaagacatacacatttatttgatcatagttttacataacagaggagccttcagatgagaatccaaagatacaagagaaacttcccatttttatgcttaggttcaaagccatatggacagccatgtagaaatatgattgaacatgaagggcatgatctaatactgatggactgagtgaagaagcccagcaagacccatcgtgagattctttttggcctctctgagcagtgttccttttttcttggtatgcaataagacctctctggaatggaggtcttatgatctacaatccagtaaggtggccttttgccccacccccagcatacaatgatggaaatagccaatgtgagttctccagaagtctttgtcctcctgggcttctccacacgaccctcactagaaactgtcctcttcatagttgtcttgagtttttacatggtatcgatcttgggcaatggcatcatcattctggtctcccatacagatgtgcacctccacacacctatgtacttctttcttgccaacctccccttcctggacatgagcttcaccacgagcattgtcccacagctcctggctaacctctggggaccacagaaaaccataagctatggagggtgtgtggtccagttctatatctcccattggctgggggcaaccgagtgtgtcctgctggccaccatgtcctatgaccgctacgctgccatctgcaggccactccattacactgtcattatgcatccacagctttgccttgggctagctttggcctcctggctggggggtctgaccaccagcatggtgggctccacgctcaccatgctcctaccgctgtgtgggaacaattgcatcgaccacttcttttgcgagatgcccctcattatgcaactggcttgtgtggataccagcctcaatgagatggagatgtacctggccagctttgtctttgttgtcctgcctctggggctcatcctggtctcttacggccacattgcccgggccgtgttgaagatcaggtcagcagaagggcggagaaaggcattcaacacctgttcttcccacgtggctgtggtgtctctgttttacgggagcatcatcttcatgtatctccagccagccaagagcacctcccatgagcagggcaagttcatagctctgttctacaccgtagtcactcctgcgctgaacccacttatttacaccctgaggaacacggaggtgaagagcgccctccggcacatggtattagagaactgctgtggctctgcaggcaagctggcgcaaatttagagactccagtgccttctgagaaggaagatcaagtttacatcgagcaaagtgaccttggaagacagggcacttgggatgtcgtttttcttctaatattgtttgagctcaaggtagatggaaatctgaaaggagtgtgctcatgccatttccagaccaagaaaatacatttattatttgctaattatcatagttttgttcaattgcgttgttggtttttgctatatatacacatgttgactgtcatcttgttttgtaaactccttgcgttgttgttcagctgttcctcagtatccgaagcgggtggattccaggacgctccgtggataataaactttgacgacgctgagagcgcgcggggagaccggagccggcctgttccccagagcccccggagccctcccagccctcaggcctgcgcctggggtgagctgagcccgggactccgccttgcaggctccggaaccctcgctgtggctcccccgctcggcccaggccttgaagccgcggcgaacctcttcctaccctacctcggggacctggtggcagcggcggcctcccccagcctggaccccgccggccgcgggtctcccggcccaaccccaccgacccagaccaagaccgcgccgagccgccgggactcagcgccttcgggtggcggcggtaagcggggaggaaacatggcgccgcccaaatgcgcccggaggccgttaggctgtggagggcgaggaaggcggtccagaggcggccggcaggtccacgtcctgggcgaccgctctgtcgcagttgggcgagacctacctagtcctgacgggtcgtatttccaagacattttcatattctatccattgttttgtgtgcattttattacttctgtatatagaggtaacaacgctaagcttttttgagatgtctgtttcttctagatgttctgaagtacctgatacatgttaaaattagaggtagtaaaatgacacattttgtaaataactttttgttaaaattcataggaaatgttattttgtgggggggggatggcatggtgtttgtggactggttcagggaaggaggggaaaagggaggtgcagagagctctaagccagtgtgcttacagtgaggcgagattcaccattgtttcttatgattgtgcattttgttttacttatctatgtatacagtgtatctaaaggacaaacgagtcctaatttacaacagctagtctttccagatgttaaagaacttctatcaatagagtaacctatcactagagttcacctctatcaatagagtaacctcattctctgcctgatgattcaaaggcatgggaagaccaaaaccatgtggcagttcctgtttttgattttattatatatatgtatataatatgaaagtagtcattaaagtagtctttcctttcgta

SEQ ID NO: 4357 - DNA, 1110 bp, Homo sapiens
ggcagttcctaagcctgcacttctgaattatataattttataggtatgcctgtctatggttagcacatagtgacttcttactgaaaaggacaacaaactatgagacagataaatcagacacaagtgacagaattcctccttctgggactctctgatgggccacacaccgagcagctgctatttatcgtattattgggtgtctacctggtcactgtgcttggaaatctgcttctaatctcccttgttcatgttgactcccaacttcacacacccatgtatttttttctctgcaacttgtctctggctgacctctgtttctctaccaacatagttcctcaggcactagtccacctgctttccagaaagaaggtcattgcattcacactttgcgcagctcgacttctctttttcctcatttttgggtgtacccagtgcgcccttcttgcagtgatgtcctatgatcgctatgttgcaatctgcaatcctctgcgttaccctaacatcatgacctggaaagtgtgtgtccagctggcaacaggatcatggaccagtggcattctggtgtctgtggtagacaccaccttcatactgaggctaccctaccgaggcagtaacagcattgctcatttcttttgtgaggcccctgcactattgatcttagcatccacagacacccatgcatcagagatggccatttttcttatgggggttgtgattctcctcatacctgtttttctgattctggtatcctatggccgtatcatagtaactgtggtcaagatgaagtcaactgtggggagtctcaaggcattttctacctgtggctcccacctcatggtggtcatacttttttatggatcagcaattatcacttacatgacacccaagtcttccaaacagcaggaaaaatcggtgtctgttttctatgcaatagtgactcccatgcttaatcccctcatctatagcctgagaaacaaggatgtgaaggcagctctgaggaaagtagccacaaggaatttcccatgaaggcttggaatctcacactgacagtgagctcagagaaccttttggcttcctacttcaaagacttgctgggaagacatggaatca

SEQ ID NO: 4358 - DNA, 1060 bp, Homo sapiens
caagacttgatgtcacagacccaaaaaaatgtgttcttttttcttgtgccaaacaggtaaacaggcaaaaatatcaatgggagaagaaaaccaaacctttgtgtccaagtttatcttcctgggtctttcacaggacttgcagacccagatcctgctatttatccttttcctcatcatttatctgctgaccgtgcttggaaaccagctcatcatcattctcatcttcctggattctcgccttcacactcccatgtatttttttcttagaaatctctcctttgcagatctctgtttctctactagcattgtccctcaagtgttggttcacttcttggtaaagaggaaaaccatttctttttatgggtgtatgacacagataattgtctttcttctggttgggtgtacagagtgtgcgctgctggcagtgatgtcctatgaccggtatgtggctgtctgcaagcccctgtactactctaccatcatgacacaacgggtgtgtctctggctgtccttcaggtcctgggccagtggggcactagtgtctttagtagataccagctttactttccatcttccctactggggacagaatataatcaatcactacttttgtgaacctcctgccctcctgaagctggcttccatagacacttacagcacagaaatggccatcttttcaatgggcgtggtaatcctcctggcccctgtctccctgattcttggttcttattggaatattatctccactgttatccagatgcagtctggggaagggagactcaaggctttttccacctgtggctcccatcttattgttgttgtcctcttctatgggtcaggaatattcacctacatgcgaccaaactccaagactacaaaagaactggataaaatgatatctgtgttctatacagcggtgactccaatgttgaaccccataatttatagcttgaggaacaaagatgtcaaaggggctctcaggaaactagttgggagaaagtgcttctctcataggcagtgacctctgagtctgacttttagagctatggcaacattcttt

SEQ ID NO: 4359 - DNA, 1082 bp, Homo sapiens
gactcccttcacagattaataatccttgaatattttaatgggaacagataaccagacttgggtgagtgaatttattctcctcggcctgtccagtgactgggacactcgggtctccctgtttgtcctgttcttggtcatgtatgtggtgaccgtgctggggaactgtctcattgtccttctgatcagactggacagccgactccacactcccatgtatttctttctcaccaacctctcccttgtcgatgtctcctatgccacaagtgtagtccctcagctgctggcacattttcttgcagaacataaagccatcccattccagagctgtgcagcccagttatttttctccctggccttgggtgggattgagtttgttctcctggcggtgatggcctatgaccgctatgtggctgtgtgtgatgccctgcgatactcggccatcatgcatggagggctgtgtgctaggttggccatcacatcctgggtcagtggcttcatcagctctcctgtgcagactgctatcacctttcagctgcccatgtgcagaaacaagtttattgatcacatatcctgtgaactcctagctgtggtcaggctggcttgtgtggacacctcctccaatgaggtcaccatcatggtgtctagcattgttcttctgatgacacccttctgcctggttcttttgtcctacatccagatcatctccaccatcctaaagatccagtccagagaaggaagaaagaaagctttccacacgtgtgcctctcacctcacagtggttgccctgtgctatggtgtggccattttcacttacatccagccccactccagtccctctgtccttcaggagaagttgttctctgtcttttatgccattttaacaccaatgctgaaccccatgatttacagcctaaggaataaagaggtgaagggggcctggcagaaactattatggaaattctctgggttaacatcaaagctggcaacttgactcatgagtatgacttagagaaaacagctttgcctcagtgttctccacccagctgagatctgacaggtgtaaactacattgccctggcaac

SEQ ID NO: 4360 - DNA, 1114 bp, Homo sapiens
tctttgattcaacagcttctgtttttttctgactctttctacagattaatattcctcacatttttaaatggaaatagataaccagacgtgggtgagagaatttattctccttggcttatccagtgactggtgcactcagatatccctgttttccctgttcttggtcacatacctcatgacagtgctggggaactgtctcattgtccttctgatcagactggacagccgactccacactcccatgtatttctttctcaccaacctctcccttgtcgatgtctcctatgccacaagcgtagtcccccagctgctggcacattttcttgcagaacataaagccatcccattccagagctgtgcagcccagttatttttctccctggccttgggtgggattgagtttgttctcctggcagtgatggcctatgaccgccatgtggctgtgtctgaccgcctgcgatactcggccatcatgcatggagggctgtgtgctaggttggccatcacatcctgggtcagtggctccatcaactctcttgtgcagactgctatcacctttcagctgcccatgtgcactaacaagtttattgatcacatatcctgtgaactcctagctgtggtcaggctggcttgtgtggacacctcctccaatgaggctgccatcatggtgtctagcattgttcttctgatgacacctttctgcctggttctgttgtcctacatccggatcatctccaccatcctaaagatccagtccagagaaggaagaaagaaagccttccacacgtgtgcctctcacctcacggtggttgccctgtgctacggcacaacgattttcacttacatccagccccactctggtccctcagtccttcaagagaagctgatctctgtcttctatgccattgttatgcctctgctgaaccctgtgatttatagtctaaggaataaagaggtgaagggggcctggcataaactattagagaaattctctgggttaacatccaagctgggaacttgactcatgaacattactttaagaagaagctttgcctcatttttctccacccagctcagatatggcagggataaactatgttgctctggcaaccgg

SEQ ID NO: 4361 - DNA, 954 bp, Homo sapiens
atggggatggtgagacataccaatgagagcaacctagcaggtttcatccttttagggttttctgattatcctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcccggctgtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgctcatcaagctggcttgtgtgggcaccacgtttaacgaggctgagctttttgtggctagtatccttttccttatagtgcctgtctcattcatcctggtctcctctggctacattgcccacgcagtgttgaggattaagtcagctaccaggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatga

SEQ ID NO: 4362 - DNA, 983 bp, Homo sapiens
ttcctgccttaggtgcggatccccctggagggatgggattgggcaatgagagttccctaatggatttcatccttctaggcttctcagaccaccctcgtctggaggctgttctctttgtatttgtccttttcttctacctcctgacccttgtgggaaacttcaccataatcatcatctcatatctggatccccctcttcataccccaatgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccactgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttatttgcgaagtaccagctcttctcaagttggcttgtgtggacaccactgtcaatgaattggtgctttttgttgttagtgttctgtttgttgtcattccaccagcactcatctccatctcctatggcttcataactcaagctgtgctgaggatcaaatcagtagaggcaaggcacaaagccttcagcacctgctcctcccaccttacagtggtgattatattctatggcaccataatctacgtgtacctgcaacctagtgacagctatgcccaggaccaagggaagtttatctccctcttctacaccatggtgacccccactttaaatcctatcatctatactttaaggaacaaggatatgaaagaggctctgaggaaacttctctcgggaaaattgtgattcctatggacatgatttgca

SEQ ID NO: 4363 - DNA, 1049 bp, Homo sapiens
tgaagctgaagagtcctgaagctgcaggaaaaatggaggaaaccaacaacagctctgaaaagggatttcttctcctgggattttcagatcagcctcagctagagaggtttctttttgccatcattttgtacttctacgtcttgagccttctggggaacactgccctcatactagtatgttgtctggactccagactccacactccaatgtacttcttcctcagcaacctctcgtgtgtggacatctgctttaccaccagtgttgccccacagttgctggttaccatgaataagaaagacaaaaccatgagctacggtggctgtgtggcccagctctatgtggccatggggttgggctcgtctgagtgtattctcttggccgtcatggcttatgaccgctatgctgctgtctgccggccactgcgctacatagccattatgcaccccaggttctgtgcgtctctggccggtggagcatggctcagcggcctcatcacctccctaattcagtgctccctcactgtgcagctgcccctctgtggtcatcgcacactggatcatattttctgtgaggtgccagtgctcatcaaactggcctgtgtggatacgactttcaacgaggcagaactctttgtggccagtgtagtctttctaattgtcccggtgttactcatcttagtctcctatggctttatcactcaagctgtgttaaggataaaatcagctgcgggccgccaaaaggcctttgggacctgttcgtctcacctggttgtggtcatcattttctatgggaccatcatattcatgtaccttcaaccggccaataggagatccaaaaaccagggaaagtttgtttctcttttctataccatagtcaccccacttttaaaccccattatctacactctgagaaacaaagatgtgaaaggggccttgaggaccctgatactgggtagtgctgctggacaaagccacaaggactaggaaacacctggaattctaaacaagggaaacacctcaaggcagagtgagggttcatcctccccagac

SEQ ID NO: 4364 - DNA, 2253 bp, Homo sapiens
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4365 - DNA, 3021 bp, Homo sapiens
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4366 - DNA, 3024 bp, Homo sapiens
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4367 - DNA, 2253 bp, Homo sapiens; identical to SEQ ID NO: 4364

SEQ ID NO: 4368 - DNA, 2253 bp, Homo sapiens
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4369 - DNA, 1294 bp, Homo sapiens
tgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaa

SEQ ID NO: 4370 - DNA, 1294 bp, Homo sapiens; identical to SEQ ID NO: 4369

SEQ ID NO: 4371 - DNA, 3021 bp, Homo sapiens; identical to SEQ ID NO: 4365

SEQ ID NO: 4372 - DNA, 3024 bp, Homo sapiens; identical to SEQ ID NO: 4366

SEQ ID NO: 4373 - DNA, 1294 bp, Homo sapiens
tgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaa

SEQ ID NO: 4374 - DNA, 3021 bp, Homo sapiens
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggaaccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4375 - DNA, 3024 bp, Homo sapiens
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggaaccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4376 - DNA, 3021 bp, Homo sapiens; identical to SEQ ID NO: 4365

SEQ ID NO: 4377 - DNA, 2253 bp, Homo sapiens; identical to SEQ ID NO: 4368

SEQ ID NO: 4378 - DNA, 1294 bp, Homo sapiens; identical to SEQ ID NO: 4373

SEQ ID NO: 4379 - DNA, 1294 bp, Homo sapiens; identical to SEQ ID NO: 4369

SEQ ID NO: 4380 - DNA, 2253 bp, Homo sapiens; identical to SEQ ID NO: 4364

SEQ ID NO: 4381 - DNA, 1294 bp, Homo sapiens; identical to SEQ ID NO: 4369

SEQ ID NO: 4382 - DNA, 3024 bp, Homo sapiens
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4383 - DNA, 3021 bp, Homo sapiens
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4384 - DNA, 1294 bp, Homo sapiens; identical to SEQ ID NO: 4373

SEQ ID NO: 4385 - DNA, 3024 bp, Homo sapiens
gtcactcagtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4386 - DNA, 2253 bp, Homo sapiens; identical to SEQ ID NO: 4368

SEQ ID NO: 4387 - DNA, 2253 bp, Homo sapiens
tcatgtgtctcagcacagtcttttacagcaaaaatgcatgtcacctcctcctaaaggctttccgtggcccacccacccagattcctcctttattgtgcagactctttcctaacccacacctcatcttaatttatttgccttcaattctgggcggcggtgttggggagggtctcaattttcccatgtatttcccagtgtttattgaatacatgaggccatactcttctagtctctctgcttctcatgctaggaactgaaccgaccagcctatactttaaggcttgttatttcactgactaaggaaaggctacttaagagggcaagctcagacatacataatctggagtggatcttccatgggaaaacacgtatataacagaaattattggcaaaactataagtatggtctacagactttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaattctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4388 - DNA, 2998 bp, Homo sapiens
gtttgcttttagttctcattgtgagatcacaagtggaggctccaaccagtccagaagttcctttctatggggaagctgtggcagcaaggccgtgaagagagtctgacttaattgcaatgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcatgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattgg

SEQ ID NO: 4389 - DNA, 3024 bp, Homo sapiens; identical to SEQ ID NO: 4366

SEQ ID NO: 4390 - DNA, 1294 bp, Homo sapiens; identical to SEQ ID NO: 4369

SEQ ID NO: 4391 - DNA, 2253 bp, Homo sapiens; identical to SEQ ID NO: 4387

SEQ ID NO: 4392 - DNA, 3021 bp, Homo sapiens; identical to SEQ ID NO: 4383

SEQ ID NO: 4393 - DNA, 3024 bp, Homo sapiens; identical to SEQ ID NO: 4382

SEQ ID NO: 4394 - DNA, 3021 bp, Homo sapiens
agtacagctcccatgcaaagtttgcttttagttctcattgtgagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattggaaggaaaa

SEQ ID NO: 4395 - DNA, 3024 bp, Homo sapiens; identical to SEQ ID NO: 4385

SEQ ID NO: 4396 - DNA, 3021 bp, Homo sapiens; identical to SEQ ID NO: 4394

SEQ ID NO: 4397 - DNA, 2998 bp, Homo sapiens; identical to SEQ ID NO: 4388

SEQ ID NO: 4398 - DNA, 2998 bp, Homo sapiens; identical to SEQ ID NO: 4388

SEQ ID NO: 4399 - DNA, 2998 bp, Homo sapiens
gtttgcttttagttctcattgtgagatcacaagtggaggctccaaccagtccagaagttcctttctatggggaagctgtggcagcaaggccgtgaagagagtctgacttaattgcaatgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggaaccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattgg

SEQ ID NO: 4400 - DNA, 2998 bp, Homo sapiens
gtttgcttttagttctcattgtgagatcacaagtggaggctccaaccagtccagaagttcctttctatggggaagctgtggcagcaaggccgtgaagagagtctgacttaattgcaatgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattgg

SEQ ID NO: 4401 - DNA, 2998 bp, Homo sapiens; identical to SEQ ID NO: 4400

SEQ ID NO: 4402 - DNA, 2998 bp, Homo sapiens
gtttgcttttagttctcattgtgagatcacaagtggaggctccaaccagtccagaagttcctttctatggggaagctgtggcagcaaggccgtgaagagagtctgacttaattgcaatgaagatcggttaattaatccatgttttacatcagctttctttgccctcaaccaggaagtcagaggcaccaatgtgaggttccacctgctttccagcacattcttggtttcctcacttctgctagacaacgtttgatcagaaggaacagggaacgagaaggagctgctggatgacaataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttcgaaagtaagaagagtttcttcaagatttatgaacatgttaagttttccagactactacccttcccacatacacctgagccactgtggtgggtcacagtgtggctatgttatctatgagagggagaatgagaaagagagggacagagagataaaagaaattgggtgagaggagataggtagctccataaggcacacaaattcaaatattatcattcctatcactgtccattcttaatatttctatcctccattctgttctttttactgtcatcacttctatagatttcctaactccaccatgcctatttctggttatataattgctctccaattgtcatgtcagtgtaggggaactactccatcatagcattctggacaccttgcatgtatctacgtaggtcatgtaagcaaaggcttgaagaacagctaatctgagatttagaagaatgctttttgatcctcctggaatatgagaggatgggaggccctttagaacctgcctcaatgccatctctcactctccttcttatatccctgggagtatgtcatgtgacaagtctttactgtctcccaggttttggatggagcatggggttttctgccccacaccctttaggatatagctgaagaatataatgaggaatagctggattctagaactgactcctcaccagtggtatattccacaacagtgtcacagtcgtctggcccctttggtttccgtgtcatcctttttggtgtgtaggacaaggagccagggaattggcacgtttggcttttacttcttttttatatgtaaataataagccatctaagtgtaaaagtggctcatatcttctccagccaaatcagctaggccatggccttgccttgcttctcatgagtgtgcttgacagtcatcaccgtcactctatcttcatttctggttcttaccgtgttagcttagttcattcaagctactatcacaagctacacataaattgggtggtttataaataacaaacatttctttcttacagttctggaggctggaaactccaagattaaggcagatttcatgcctattgagggcctgctttctgattatagaaggtgacttcttgctgtgcccacacatggtgaaagggactaccaactctctggagtctcttttatgagggcactaattccaattatgaagcctcttccctcgtgacctaatcactgcccaaaggccccatgttctaatgccatcatcttggtggtttaggatttcaacatatgaattttggaaggacataagcattcaaccccctgcacatgtcttctttcctacttcctcaaggttctttctgtccagttgctccttcttctattgacccttttttgccttctctttctccttcactgcctcaagttacagccagaggaaaggaggaactaaaacttagcaaatctataatcacatgcaaatacacagaatggattgttacaaccaaaatgcaggctctattgttttcaatttagcagcctttcaaatgtatatggttctggccacattaaagttgcaaataacactttttttgagactgaaataaaggtgaaatattgg

SEQ ID NO: 4403 - DNA, 2998 bp, Homo sapiens; identical to SEQ ID NO: 4402

SEQ ID NO: 4404 - DNA, 1063 bp, Homo sapiens
tgacagcctcatccctccaggtacaaacaagaacaggccatggttaaccaaagctccacaccgggcttcctccttctgggcttctctgaacacccagggctggaaaggactctcttcgtggttgtcctcacttcctacctcctaaccctagtgggcaacacactcatcatcctgctgtctgcgctggaccccaagctccactctccaatgtactttttcctctccaacctctccttcttggacctctgtttcaccacgagttgtgttccccaaatgctggtcaacctctggggcccaaagaagaccatcagcttcctggactgctctgtccagatcttcatcttcctgtccctggggacaactgagtgcatcctcttgacagtgatggcttttgatcgctacgtggctgtctgccagcccctccactatgccaccatcatccacccccgcctgtgctggcagctggcatctgtggcctgggtcattgggctagtggagtcagtggtccagacaccatccaccctgcacctgcccttctgccccgatcggcaggtggatgattttgtctgtgaggtcccagctctaattcgactctcctgtgaagacacctcctacaatgagatccaggtggctgttgccagtgtcttcatcttggttgtgcctctcagcctcatccttgtctcttacggagccattacctgggcagtgctgaggattaactctgcaaaagggcggaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggggaaggaaatggggctcacacaaagctgagggagagctgcttaatgtgctttaaaagagaggagattctatgtgcttttatcagaaagtttgagttccctgcccctctgccttc

SEQ ID NO: 4405 - DNA, 1063 bp, Homo sapiens; identical to SEQ ID NO: 4404

SEQ ID NO: 4406 - DNA, 1063 bp, Homo sapiens; identical to SEQ ID NO: 4404

SEQ ID NO: 4407 - DNA, 1273 bp, Homo sapiens
aatcaatttaactttttaaaataaaaaattattttcttaaatattgtctttctgattatggaatatcttagtcttcatttatccaaatgttaactcaaggatgtatataaaagaactcagtaacttgaaaagctattacttgtatccacagctggacaaatatctcaatgaagcatacaaaggaaactgtataaaaattctactgccataatggtgcacactatctggaattgggatacttttttctccaatctgtttgcaagtgagcagttggcaatgcatggacagactttgagtttatgcgattctttctttaggtacaggaaaaataagaatgttgatgaaaaaaaatgcaagttttgaagacttctttcttctacttggattttctaactggcctcatctggaagtagttctctttgtggttatcttgatcttctacttgataacactgataggaaacctgttcatcatcatcctgtcatacctggactcccatctccacactcccatgtacttcttcctttcaaatctctcatttctggatctctgctacaccaccagctctatccctcagttgctggtgaatctctggggcccggaaaagaccatctcttatgctggttgtacggttcaactttactttgttctcgcactgggaaccgcagagtgtgtcctactggtggtgatgtcctatgatcgttatgcagctgtgtgtagacctttgcattacactgtcctcatgcaccctcgtttctgccgcttgttggctgcggcttcttgggtaagtggttttacaacctcagcacttcattcctcctttactttctggatacccctatgtagacatcgcctagtggatcacttcttctgtgaagttccagcacttctgcgattatcatgtgttgatacccaggcaaatgagctgaccctcatggtcatgagctccatatttgttctcatacctctcatcctcatcctcacttcctatggtgccattgcccgggctgtactgagcatgcaatcaaccactgggcttcagaaagtgcttaggacatgtggagcccatcttatggttgtatctctctttttcattccagtcatgtgcatgtatctccagccaccatcagaaaattctcaagatcaaggcaagttcattgccctcttttacactgttgtcacacctagtcttaaccctctaatctacactttcagaaacaaggatgtaagaggggcagtgaagagactaatggggtgggaatgggggatgtga

SEQ ID NO: 4408 - DNA, 1041 bp, Homo sapiens
gggatacttttgtcttcaatctgtttgcaagtgagcggttgacaatgcatggacagactttgagtttatgtggttctttctttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgccacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggctgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctgattctcactgcctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 4409 - DNA, 1041 bp, Homo sapiens; identical to SEQ ID NO: 4408

SEQ ID NO: 4410 - DNA, 1041 bp, Homo sapiens
gggatacttttgtcttcaatctgtttgcaagtgagcggttgacaatgcatggacagactttgagtttatgtggttctttttttaggtataagaaaaagatgaatgatgattaaaaaaaatgcaagttcggaagacttctttattctacttggattttctaattggcctcagctggaagtagttctctttgtggttatcttgatcttctacctgatgacactgacaggaaacctgttcatcatcatcctgtcatacgtggactcccatctccacacaccaatgtacttcttcctttcaaacctctcatttctggatctctgccacaccaccagctctatccctcagttgctggtgaatctccggggcccggaaaagaccatctcgtatgctggttgcatggttcaactttactttgttcttgcactgggaatcgcagagtgtgtcctactggtggtgatgtcgtatgatcgttatgtagctgtgtgtagacctttgcattacactgtcctcatgcaccctcgtttctgccacttgttggctgcggcttcttgggtaattggttttactatctcagcacttcattcctcctttactttctgggtacccctttgtggacatcgcctagtggatcacttcttctgtgaagttccagcacttctgcgtttatcatgtgttgacacccatgcaaatgagctgaccctcatggtcatgagctccatttttgttctcatacctctcattctgattctcactgcctatggtgccattgcccgggctgtactgagcatgcaatcaaccactgggcttcagaaagtgtttaggacatgtggagcccatcttatggttgtatctctctttttcattccagtcatgtgcatgtatctccagccaccatcagaaaattctcctgatcagggcaagttcattgccctcttttatactgttgtcacaccgagtcttaatcctctaatctacactctcagaaacaagcatgtaaaaggggcagcgaagagactattggggtgggagtgggggaagtga

SEQ ID NO: 4411 - DNA, 1041 bp, Homo sapiens; identical to SEQ ID NO: 4408

SEQ ID NO: 4412 - DNA, 1041 bp, Homo sapiens; identical to SEQ ID NO: 4408

SEQ ID NO: 4413 - DNA, 936 bp, Homo sapiens
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccgagctgtactgaggatgcagtcaaccactgggcttcagaaagtgtttggaacatgtggagctcatcttatggctgtatctctctttttcattccggccatgtgcatatatctccagccaccatcaggaaattctcaagatcaaggcaagttcattgccctcttttatactgttgtcacacctagtcttaaccctctaatctacaccctcagaaacaaagttgtaagaggggcagtgaagagactaatggggtgggaatga

SEQ ID NO: 4414 - DNA, 936 bp, Homo sapiens; identical to SEQ ID NO: 4413

SEQ ID NO: 4415 - DNA, 936 bp, Homo sapiens; identical to SEQ ID NO: 4413

SEQ ID NO: 4416 - DNA, 936 bp, Homo sapiens; identical to SEQ ID NO: 4413

SEQ ID NO: 4417 - DNA, 774 bp, Homo sapiens
atgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccaagctgtactgaggatgcagtcaaccactgggcttcagaaagtgtttggaacatgtggagctcatcttatggctgtatctctctttttcattccggcc

SEQ ID NO: 4418 - DNA, 936 bp, Homo sapiens; identical to SEQ ID NO: 4413

SEQ ID NO: 4419 - DNA, 936 bp, Homo sapiens; identical to SEQ ID NO: 4413

SEQ ID NO: 4420 - DNA, 951 bp, Homo sapiens
atgcaaggagaaaacttcaccatttggagcatttttttcttggagggattttcccagtacccagggttagaagtggttctcttcgtcttcagccttgtaatgtatctgacaacgctcttgggcaacagcactcttattttgatcactatcctagattcacgccttaaaacccccatgtacttattccttggaaatctctctttcatggatatttgttacacatctgcctctgttcctactttgctggtgaacttgctgtcatcccagaaaaccattatcttttctgggtgtgctgtacagatgtatctgtcccttgccatgggctccacagagtgtgtgctcctggccgtgatggcatatgaccgttatgtggccatttgtaacccgctgagatactccatcatcatgaacaggtgcgtctgtgcacggatggctacggtctcctgggtgacgggttgcctgaccgctctgctggaaaccagttttgccctgcagatacccctctgtgggaatctcatcgatcacttcacgtgtgaaattctggcggtgctaaagttagcttgcacaagttcactgctcatgaacaccatcatgctggtggtcagcattctcctcttgccaattccaatgctcttagtttgcatctcttacatcttcatcctttccactattctgagaatcacctcagcagagggaagaaacaaggctttttctacctgtggtgcccatttgactgtggtgattttgtattatggggctgccctctctatgtacctaaagccttcttcatcaaatgcacaaaaaatagacaaaatcatctcgttgctttacggagtgcttacccctatgttgaaccccataatttacagtttaagaaacaaggaagtcaaagatgctatgaagaaattgctgggcaaaataacattgcatcaaacacacgaacatctctga

SEQ ID NO: 4421 - DNA, 1038 bp, Homo sapiens
atgaatatcacactttattcatttctttatgtcctcagattaaatgaagggaatagtactggaagaaatatagatgaaagaaagaaaatgcaaggagaaaacttcaccatttggagcatttttttcttggagggattttcccagtacccagggttagaagtggttctcttcgtcttcagccttgtaatgtatctgacaacgctcttgggcaacagcactcttattttgatcactatcctagattcacgccttaaaacccccatgtacttattccttggaaatctctctttcatggatatttgttacacatctgcctctgttcctactttgctggtgaacttgctgtcatcccagaaaaccattatcttttctgggtgtgctgtacagatgtatctgtcccttgccatgggctccacagagtgtgtgctcctggccgtgatggcatatgaccgttatgtggccatttgtaacccgctgagatactccatcatcatgaacaggtgcgtctgtgcacggatggctacggtctcctgggtgacgggttgcctgaccgctctgctggaaaccagttttgccctgcagatacccctctgtgggaatctcatcgatcacttcacgtgtgaaattctggcggtgctaaagttagcttgcacaagttcactgctcatgaacaccatcatgctggtggtcagcattctcctcttgccaattccaatgctcttagtttgcatctcttacatcttcatcctttccactattctgagaatcacctcagcagagggaagaaacaaggctttttctacctgtggtgcccatttgactgtggtgattttgtattatggggctgccctctctatgtacctaaagccttcttcatcaaatgcacaaaaaatagacaaaatcatctcgttgctttacggagtgcttacccctatgttgaaccccataatttacagtttaagaaacaaggaagtcaaagatgctatgaagaaattgctgggcaaaataacattgcatcaaacacacgaacatctctga

SEQ ID NO: 4422 - DNA, 1692 bp, Homo sapiens
agcaaaagttgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagcgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggta

SEQ ID NO: 4423 - DNA, 1883 bp, Homo sapiens
ccggaggacgcgctgctgcgagaccagccgcggcgtctttggcagtagtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgagcaaaagttgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagcgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggt

SEQ ID NO: 4424 - DNA, 1134 bp, Homo sapiens
tgggagtcttgtaatgcagccactgtggataaaagtgaattactgttcttaatttacccttttgtctcccttcaggatggattgtaggaattccccatggaaaattacaatcaaacatcaactgatttcatcttattggggctgttcccacaatcaagaattggccttttcgtattcaccctcatttttctcattttcctaatggctctaattggaaatctatccatgattcttctcatctttttggacatccatctccacacacctatgtatttcctacttagtcagctctccctcattgacctaaattacatctccaccattgttccaaagatggtttatgattttctgtatggaaacaagtctatctccttcactggatgtgggattcagagtttcttcttcttgactttagcagttgcagaagggctgctcctgacatcaatggcctatgatcgttatgtggccatttgctttcctctccactatcccatccgtataagcaaaagagtgtgtgtgatgatgataacaggatcttggatgataagctctatcaactcttgtgctcacacagtatatgcactctgtatcccatattgcaagtccagagccatcaatcattttttctgtgatgttccagctatgttgacgctagcctgcacagacacttgggtctatgagagcacagtgtttttgagcagcaccatctttcttgtgcttcctttcactggtattgcatgttcctatggccgggttctccttgctgtctaccgcatgcactctgcagaagggaggaagaaggcctattcaacctgtagcacccacctcactgtagtgtccttctactatgcaccctttgcttatacctatgtacgtccaagatccctgcgatctccaacagaggacaagattctggctgttttctacaccatcctcaccccaatgctcaaccccatcatctacagcctgagaaacaaggaggtgatgggggccctgacacaagtgattcagaaaatcttctcagtgaaaatgtagacatacgttctgtgttagagtcaaagcgctaggttcatatcaacttagtagtgtacagcagtgaagaaaaacattattacatgcccagtgtgtcaaaca

SEQ ID NO: 4425 - DNA, 939 bp, Homo sapiens
atggaaaattacaatcaaacatcaactgatttcatcttattaggattcttcccaccatcaagaattggccttttcctcttcatcctcattgttttcattttcctaatggctctaattggaaacctatccatgattcttctcatcttcttggacacccatctccacacacccatgtatttcctacttagtcagctctccctcattgacctaaattacatctccaccattgttcctaagatggcatctgattttctgtctggtaacaagtctatctccttcactgggtgtgggattcagagtttcttcttctcggcattaggaggtgcagaagcactacttttggcatctatggcctatgatcgttacattgctatttgctttcctcttcactatcccatccgcatgagcaaaagaatgtgtgtgctgatgataacagggtcttggatcataggctcgatcaatgcttgtgctcacactgtatatgtactccatattccttattgccaatccagggccatcaatcatttcttctgtgatgtcccagcaatggtgactctggcctgcatggacacctgggtctatgagggcacagtgtttttgagcaccaccatctttctcgtgtttcccttcattgctatttcatgttcctatggccgggttctccttgctgtctaccacatgaaatctgcagaagggaggaagaaagcctacctgacctgcagcacccacctcactgtagtaactttctactatgcaccttttgtctacacttatctacgtccaagatccctgcgatctccaacagaggacaaggttctggctgtcttctacaccaccctcactccaatgctcaaccccatcatctatagcctgaggaacaaggaggtgatgggggccctgacacgagtgagtcagagaatctgctctgggaaaatgtag

SEQ ID NO: 4426 - DNA, 939 bp, Homo sapiens
atggaaaattacaatcaaacgtcaactgatttcatcttattggggctgttcccaccatcaaaaattggccttttcctcttcattctctttgttctcattttcctaatggctctaattggaaacctatccatgattcttctcatcttcttggacacccatctccacacacccatgtatttcctgcttagtcagctctccctcattgacctaaattacatctctacgattgttcctaagatggcttctgattttctgtatggaaacaagtctatctccttcattgggtgtgggattcagagtttcttcttcatgacttttgcaggtgcagaagcgctgctcctgacatcaatggcctatgatcgttatgtggccatttgctttcctctccactatcccatccgtatgagcaaaagaatgtatgtgctgatgataacaggatcttggatgataggctccatcaactcttgtgctcacacagtatatgcattccgtatcccatattgcaagtccagagccatcaatcattttttctgtgatgttccagctatgttgacattagcctgtacagacacctgggtctatgagtacacagtgtttttgagcagcaccatctttcttgtgtttcccttcactggcattgcgtgttcctatggctgggttctccttgctgtctaccgcatgcactctgcagaagggaggaaaaaggcctattcgacctgcagcacccacctcactgtagtaactttctactatgcaccctttgcttatacctatctatgtccaagatccctgcgatctctgacagaggacaaggttctggctgttttctacaccatcctcaccccaatgctcaaccccatcatctacagcctgagaaacaaggaggtgatgggggccctgacacgagtgattcagaatatcttctcggtgaaaatgtag

SEQ ID NO: 4427 - DNA, 939 bp, Homo sapiens
atggaaaattacaatcaaacatcaactgatttcatcttattggggctgtttccaccatcaagaattgaccttttcttcttcattctcattgttttcattttcctgatggctctaattggaaacctgtccatgattcttctcatcttcttggacacccatctccacacacccatgtatttcctactgagtcagctctccctcattgacctaaattacatctccaccattgttcctaagatggcatctgattttctgcatggaaacaagtctatctccttcactgggtgtgggattcagagtttcttcttcttggcattaggaggtgcagaagcactacttttggcatctatggcctatgatcgttacattgctatttgctttcctctccactatctcatccgcatgagcaaaagagtgtgtgtgctgatgataacagggtcttggatcataggctcgatcaatgcttgtgctcacactgtatatgtactccatattccttattgccgatccagggccatcaatcatttcttctgtgatgtcccagcaatggtgactctggcctgcatggacacctgggtctatgagggcacagtgtttttgagtgccaccatctttctcgtgtttcccttcattggtatttcatgttcctatggccaggttctctttgctgtctaccacatgaaatctgcagaagggaggaagaaagcctatttgacctgcagcacccacctcactgtagtaactttctactatgcaccttttgtctacacttatctacgtccaagatccctgcgatctccaacagaggacaaggttctggctgtcttctacaccatcctcaccccaatgctcaaccccatcatctatagcctgaggaacaaggaggtgatgggggccctgacacgagtgagtcagagaatctgctctgtgaaaatgtag

SEQ ID NO: 4428 - DNA, 1044 bp, Homo sapiens
atggcatgggagaatcagaccttcaactccgacttcatcctccttggaatcttcaatcacagcccaccacacacgttcctcttctttctggtcctgggcatctttttagtggccttcatgggaaactctgtcatggttctcctcatctacctggacacccagctccacacccccatgtacttcctcctcagccaactgtccctcatggacctcatgctcatctgcaccaccgtacccaagatggccttcaactacctgtctggcagcaagtccatttctatggctggttgtgtcacacaaattttcttctatatatcactgtctggctctgaatgttttcttttggctgttatggcttatgaccgctatattgctatttgccaccctctaagatataccaatctcatgaatcctaaaatttgtggacttatggctaccttctcctggatcctgggctctacagatggaatcattgatgctgtagccacattttccttctccttttgtgggtctcgggaaatagcccacttcttctgtgaattcccttccctactaatcctctcatgcaatgacacatcaatatttgaagaggttattttcatctgctgtatagtaatgcttgttttccctgttgcaatcatcattgcttcctatgctcgagttattctggctgtcattcacatgggatctggagagggtcgttgcaaagctttcacgacctgttcctctcacctcatggtggtgggaatgtactatggagcagctttgttcatgtacatacggcccacatctgatcactccccaacgcaggacaagatggtgtctgtattctacaccatcctcactcccatgctgaatcccctcatctacagcctccgcaacaaggaggtgactagagcattcatgaagatcttaggaaagggcaagtctgagagtgagttacctcataaactttatgttttgctgtttgctaaattcttctttctaatatccatctttttctatgatgtcaaaatactagcattgattatgtacattgcctaa

SEQ ID NO: 4429 - DNA, 1061 bp, Homo sapiens
cgctggttttgtggtactaggtaaaaagcatacacatcatggcaagggagaattcgaccttcaactccgacttcatcctcctgggaatcttcaatcacagccccacccacaccttcctcttctttctggtcctggccatcttttcagtggccttcatgggaaactctgtcatggttctcctcatctacctggacacccagctccacacccccatgtacctcctcctcagccaactgtccctcatggacctcatgctcatctgcaccaccgtacccaagatggccttcaactacctgtctggcagcaagtccatttctatggctggttgtgccacacaaattttcttctatacatcactgcttggctctgagtgctttcttttggctgttatggcttatgaccgctacactgccatttgccaccctctaagatacaccaatctcatgagccctaaaatttgtggacttatgactgccttttcctggatcctgggctctacggatggaattattgatgttgtagcaacattttccttctcctactgtgggtctcgggaaatagcccacttcttctgtgacttcccctccctactaatcctctcatgcagtgacacatcaatatttgaaaagattcttttcatctgctgtatagtaatgattgttttccctgttgcaatcatcattgcttcctatgctcgagttatcctggctgtcattcacatgggatctggagagggtcgtcgcaaagcttttactacttgttcctctcacctcttggtggtgggaatgtactatggagcagctttgttcatgtacatacggcccacatctgatcgctccccaacacaggacaagatggtgtctgtattctacaccatcctcactcccatgttgaatcccctcatctacagcctccgcaacaaggaggtgaccagagcattcatgaagatcttaggaaagggcaagtctggagagtgagttacctaataaacttcatgttttgctgtgtgctaaatcctttttttaaatggtcctatttttccattaagccttgaaaatggg

SEQ ID NO: 4430 - DNA, 936 bp, Homo sapiens
atggtgtgggaaaaccagaccttcaactccatcttcatcctgctgggaatcttcaatcacagtcccacccacaccttccttttttctctggtcctgggcatcttctcactggcattgatggaaaatatttccatggttctcctcatctacatagagaaacagctccacacccccatgtacttcctcctcagtcaactgtcccttatggacctcatgctcatctgcaccactctacccaagatgatcttcagctacttgtctgggaagaaatctatctctctggcaggttgtggaactcagatattcttctatgtgtccctgcttggagctgaatgtttcttgttggctgtcatggcttatgaccgctatgtggctatatgtcaccctcttcagtacaccatcctcatgaatccgaaactctgtgtcttcatgactgttgcttcctggaccttggggtctcttgatgggatcatagtgcttgcagctgtcctgtcattttcttactgcagctctctggaaattcatcactttttctgtgatgttgctgcccttttacctctatcctgcacagaaacatctgcatttgaaagactacttgtcatttgttgtgtggtaatgctaatctttccagtttcagttatcatactttcctattcccatgtccttcgagccgtcatccacatgggctctggggaaagtcgtcgcaaggccttcactacctgctcctcccacctgtctgtggtcggactctactacggtgctgctatgttcatgtacatgagaccagcttctaaacatacgccagaccaggacaagatggtgtcggccttctacactattctcacccctatgctgaaccctctcatttatagcctccgcaacaaagaagtgttcagggcactacagaaggtactgaagaaaagaaagttaatatga

SEQ ID NO: 4431 - DNA, 939 bp, Homo sapiens
atggcatgggagaatcagaccttcaactctgacttcatcctcctgggaatcttcaatcacagccccacccacaccttcctcttctttctggtcctggccatcttttcagtggccttcatgggaaactctgtcatggttctcctcatctacctggacacccagctccacacccccatgtacttcctcctcagtcaactgttcctcatggacctcatgctcatctgctctaccgtacccaagatggccttcaactacttgtctggcagcaagtccatttctatggctggttgtgccacacaaattttcttctatgtatcactgcttggctccgaatgctttctgttggctgttatgtcttatgaccgctatattgccatttgccaccctctaagatacaccaatctcatgagacccaaaatttgtggacttatgactgccttctcctggatcctgggctctatggatgcaatcattgatgctgtagcgacattttccttctcctactgtgggtctcgggaaatagcccacttcttctgtgacttcccttccctactaatcctctcatgcaatgacacatcaatatttgaaaaggttcttttcatctgctgtatagtaatgattgtttttcctgttgcaatcatcatcgcttcctatgctcgagttattctggctgtcattcacatgggatctggagagggtcgtcgcaaagcttttactacctgttcctctcacctcatggtggtgggaatgtactatggagcaggtttgttcatgtacatacggcccacatctgatcgctcccctatgcaggacaagctggtgtctgtattctacaccatcctcactcccatgctgaatcccctcatctacagcctccgcaacaaggaggtgaccagagcactcaggaaagtgttaggaaagggcaagtgtggagagtga

SEQ ID NO: 4432 - DNA, 1006 bp, Homo sapiens
tgcggtgctaggtaacaggcatattcatcatggcatgggagaatcagaccttcaactctgacttcctcctcctgggaatcttcaatcatagccccacccacaccttcctcttctttctggtcctggccatcttttcagtggccttcatgggaaactccatcatggttctcctcatctacctggatacccagctccacacccccatgtacttcctcctcagccaactgtccctcatggacctcatgctcatctgcaccactgtacccaagatggccttcaactacttgtctggcagcaagtccatttctatggctggctgtgccacacaaattttcttctatatatcattgcttggctccgaatgctttctgttggctgttatgtcttatgaccgctacactgccatttgccaccctctaagatacaccaatctcatgagacccaaaatttgtggacttatgactgccttctcctggatcctgggctctacagatggaatcattgatgctgtagcgacattttccttctcctactgtgggtctcgggaaatagcccacttctgctgtgacttcccttccctactaatcctctcatgcaatgacacatcaatatttgaagaggttattttcatctgctgtatagtaatgcttgttttccctgttgcaatcatcatcacttcctatgctcgagttattctggctgtcattcacatgggatctggagagggacgtcgcaaagcttttactacttgttcctctcacctcatggtggtgggaatgtactatggagcaggtttgttcatgtgcattcagcccacatctcatcattctcctatgcaggacaagatggtgtctgtattctacaccatcgtcactcccatgctgaatcctctcatttatagcctccgcaacaaggaagtgaccagagcattaatgaaaatcttaggaaagggcaagtctggagattgagttacctcataaatttcatgttttgctgtctgctaacg

SEQ ID NO: 4433 - DNA, 1047 bp, Homo sapiens
tcccaaaaagcctgatgcgctgctcagtactttgctgatggcagaggggatatcacatggaaaaagccaatgagacctcccctgtgatggggttcgttctcctgaggctctctgcccacccagagctggaaaagacattcttcgtgctcatcctgctgatgtacctcgtgatcctgctgggcaatggggtcctcatcctggtgaccatccttgactcccgcctgcacacgcccatgtacttcttcctagggaacctctccttcctggacatctgcttcactacctcctcagtcccactggtcctggacagctttttgactccccaggaaaccatctccttctcagcctgtgctgtgcagatggcactctcctttgccatggcaggaacagagtgcttgctcctgagcatgatggcatttgatcgctatgtggccatctgcaacccccttaggtactccgtgatcatgagcaaggctgcctacatgcccatggctgccagctcctgggctattggtggtgctgcttccgtggtacacacatccttggcaattcagctgcccttctgtggagacaatgtcatcaaccacttcacctgtgagattctggctgttctaaagttggcctgtgctgacatttccatcaatgtgatcagcatggaggtgacgaatgtgatcttcctaggagtcccggttctgttcatctctttctcctatgtcttcatcatcaccaccatcctgaggatcccctcagctgaggggaggaaaaaggtcttctccacctgctctgcccacctcaccgtggtgatcgtcttctacgggaccttattcttcatgtatgggaagcctaagtctaaggactccatgggagcagacaaagaggatctttcagacaaactcatcccccttttctatggggtggtgaccccgatgctcaaccccatcatctatagcctgaggaacaaggatgtgaaggctgctgtgaggagactgctgagaccaaaaggcttcactcagtgatggtggaagggtcctctgtgattgtcaccca

SEQ ID NO: 4434 - DNA, 1110 bp, Homo sapiens
atgtggcaagaatactattttttaaatgttttcttcccacttttaaaagtttgctgcctaacaattaattcacatgttgttattttactgccctgggaatgctatcatcttatttggaagatattaccttatatcggcacaactgtaggatcaatggaagagtacaacacatcctctacagacttcactttcatggggctgttcaacagaaaggaaacctcaggtcttatttttgccatcatctctatcatcttcttcaccgcactgatggccaatggggttatgatcttcctgatccaaacagatttgcgccttcatacacccatgtacttcctcctcagccacctttccttaattgacatgatgtatatttccactattgtgcctaagatgctggttaattacctgctggatcaaaggaccatttcctttgtggggtgcacagctcaacacttcctctaccttacccttgtgggagctgaattcttcctgctgggcctcatggcctatgaccgctatgtggccatttgcaaccctctgagataccctgtcctcatgagccgccgggtctgttggatgattatagcaggttcctggtttgggggctctttggatggcttcctcctaacccccatcaccatgagctttcccttctgcaattcccgggagattaaccacttcttctgtgaggcaccagcagtcctgaagttggcatgtgcagacacagccctctacgagacagtgatgtatgtgtgctgtgttttgatgctgctgattcctttctctgtagtccttgcttcctatgcccgaatcctgactacagttcagtgcatgagctcagtggagggcaggaagaaggcatttgccacttgctcatcccacatgactgtggtgtccttgttctacggggctgccatgtacacctacatgctgccacattcttaccacaagccagcccaggacaaagtcctctctgtgttttacaccattctcacacccatgctgaaccccctcatctacagccttagaaacaaggatgtgactggagctctgaagagggccttggggaggttcaagggtcctcaaagggtgtcaggaggtgtcttttga

SEQ ID NO: 4435 - DNA, 1049 bp, Homo sapiens
caggtaaagccacttcagccgatcatacagcatgcggctggccaaccagaccctgggtggtgactttttcctgttgggaatcttcagccagatctcacaccctggccgcctctgcttgcttatcttcagtatatttttgatggctgtgtcttggaatattacattgatacttctgatccacattgactcctctctgcatactcccatgtacttctttataaaccagctctcactcatagacttgacatatatttctgtcactgtccccaaaatgctggtgaaccagctggccaaagacaagaccatctcggtccttgggtgtggcacccagatgtacttctacctgcagttgggaggtgcagagtgctgccttctagccgccatggcctatgaccgctatgtggctatctgccatcctctccgttactctgtgctcatgagccatagggtatgtctcctcctggcatcaggctgctggtttgtgggctcagtggatggcttcatgctcactcccatcgccatgagcttccccttctgcagatcccatgagattcagcacttcttctgtgaggtccctgctgttttgaagctctcttgctcagacacctcactttacaagattttcatgtacttgtgctgtgtcatcatgctcctgatacctgtgacggtcatttcagtgtcttactactatatcatcctcaccatccataagatgaactcagttgagggtcggaaaaaggccttcaccacctgctcctcccacattacagtggtcagcctcttctatggagctgctatttacaactacatgctccccagctcctaccaaactcctgagaaagatatgatgtcatcctttttctacactatccttacacctgtcttgaatcctatcatttacagtttcaggaataaggatgtcacaagggctttgaaaaaaatgctgagcgtgcagaaacctccatattaaagtgtgaaagaacttaagttggtcctctcttcttagagtctctcttcactttaggtgtccttccaccaaacaatcagca

SEQ ID NO: 4436 - DNA, 1072 bp, Homo sapiens
tcttgcctccttcctggtccttgtgtcttcccgttgccctgggacgctcgtgggccatatcaatgacgaacacatcatcctctgacttcaccctcctggggcttctggtgaacagtgaggctgccgggattgtatttacagtgatccttgctgttttcttgggggccgtgactgcaaatttggtcatgatattcttgattcaggtggactctcgcctccacacccccatgtactttctgctcagtcagctgtccatcatggacacccttttcatctgtaccactgtcccaaaactcctggcagacatggtttctaaagagaagatcatttcctttgtggcctgtggcatccagatcttcctctacctgaccatgattggttctgagttcttcctcctgggcctcatggcctatgactgctacgtggctgtctgtaaccctctgagatacccagtcctgatgaaccgcaagaagtgtcttttgctggctgctggtgcctggtttgggggctccctcgatggctttctgctcactcccatcaccatgaatgtcccttactgtggctcccgaagtatcaaccattttttctgtgagatcccagcagttctgaaactggcctgtgcagacacgtccttgtatgaaactctgatgtacatctgctgtgtcctcatgttgctcatccccatctctatcatctccacttcctactccctcatcttgttaaccatccaccgcatgccctctgctgaaggtcgcaaaaaggccttcaccacttgttcctcccacttgactgtagttagcatcttctatggggctgccttctacacatacgtgctgccccagtccttccacacccccgagcaggacaaagtagtgtcagccttctataccattgtcacgcccatgcttaatcctctcatctacagcctcagaaacaaggacgtcataggggcatttaaaaaggtatttgcatgttgctcatctgctcagaaagtagcaacaagtgatgcttagagagtcactgcccagaggataaggcttcctaaggacttcctccatttgccctgtttccc

SEQ ID NO: 4437 - DNA, 963 bp, Homo sapiens
atggagatgagaaatactaccccagattttattctcctaggactctttaaccacaccagagcccaccaagtcctcttcatgatgcttctggccaccgttttgacctccctgtttagcaatgccctcatgattctcctgattcactgggaccaccggctccacaggcccatgtacttcctcctgagccaactttccctcatggacatgatgctggtttccaccactgtgcccaaaatggcggctgactacttgaccggaaataaggccatctcccgcgctggctgtggtgtgcagatcttcttcctccccacactgggtggtggagagtgcttcctcttagcagccatggcctatgaccgctatgcggctgtctgccacccactccgatatcccactctcatgagctggcagctgtgcctgaggatgaccatgtcgtcctggctcctgggtgcagctgacggcctcctgcaggctgttgctaccctgagcttcccatattgcggtgcacacgagatcgatcacttcttctgcgaggcccccgtgttggtgcgtttggcttgtgctgacacttcagtcttcgaaaacgccatgtacatctgctgtgtgttaatgctcctggtccccttttccctcatcctgtcctcctatggtctcatcctcgctgctgttctgctcatgcgctctacagaagcccgcaagaaggcctttgccacctgctcttcacatgtggctgtggtgggactcttttatggagctggcatttttacctatatgagacccaaatcccacaggtccactaaccacgataaggttgtgtcagccttctatactatgttcacccctttactaaatcccctcatctacagtgtgaggaacagtgaggtcaaggaagccctgaaacggtggctggggacgtgtgtaaacctaaaacaccagcaaaatgaggcccacaggtcaagatga

SEQ ID NO: 4438 - DNA, 1054 bp, Homo sapiens
cccaaggagcttgtcatggaccatgggcatggagggtcttctccagaactccactaacttcgtcctcacaggcctcatcacccatcctgccttccccgggcttctctttgcaatagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcagatcttcctctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtctcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctagcagggactcccacagcatcagagtggtgactgtgatcgggaaggattagcggggact

SEQ ID NO: 4439 - DNA, 954 bp, Homo sapiens
atggagcagagcaattattccgtgtatgccgactttatccttctgggtttgttcagcaacgcccgtttcccctggcttctctttgccctcattctcctggtctttttgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctatgatcgctacgtagccatctgcaaccctctgcactatcctgtcctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtcatctcgggctcttacacaagaattctcattactgtttataggatgagcgaggcagaggggaggggaaaggctgtggccacctgctcctcacacatggtggttgtcagcctcttctatggggctgccatgtacacatacgtgctgcctcattcttaccacacccctgagcaggacaaagctgtatctgccttctacaccatccttactcccatgctcaatccactcatttacagccttaggaacaaggatgtcacaggggccctacagaaggttgtggggaggtgtgtgtcctcaggaaaggtaaccactttctaa

SEQ ID NO: 4440 - DNA, 1014 bp, Homo sapiens
acctcatggccaacatcaccaggatggccaaccacactggaaggttggatttcatcctcatgggactcttcagacaatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcaga

SEQ ID NO: 4441 - DNA, 1008 bp, Homo sapiens
tcctcagggggaaactgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttctacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagacgctcatgtacctgtgctgcatcctcatgcttctcgcccccatcatggtcatctccagctcatacaccctcatcctgcatctcatccacaggatgaattctgccgccggccacaggaaggccttggccacctgctcctcccacatgatcatagtgctgctgctcttcggtgcttccttctacacctacatgctcccgagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtagtaaagggcaagcattgtcccctcctc

SEQ ID NO: 4442 - DNA, 1066 bp, Homo sapiens
caccatcacaccaggggaaattatggagatgagaaatactaccccagattttattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacatgatgctggtttccaccactgtgcccaaaatggcggctgactacttgaccggaagtaaggccatctcccgcgctggctgtggtgtgcagatcttcttcctccccacactgggtggtggagagtgcttcctcttagcagccatggcctatgaccgctatgcggctgtctgccacccactccgatatcccactctcatgagctggcagctgtgcctgaggatgaccatgtcgtgttggctcctgggtgcagctgacgggctcctgcaggctgttgttaccctgagcttcccatattgtggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccataggtccactaaccatgacaaggttgtgtcagccttctatactatgttcacccctttactaaaccccctcatctacagtgtgaagaacagtgaggtgaagggagccctgaaacggtggctggggacgtgtgtaaacataaaacaccagcaaaatgaggcccacaggtcaagatgatctaatgtcaaatgagtctaagttcctgaatttattaatattttaacacattgttattctctccctttagcaattcatgca

SEQ ID NO: 4443 - DNA, 1059 bp, Homo sapiens
agggggaaactgtgagccagtcatgtgctcagggaatcagacttctcagaatcaaacagcaagcactgatttcaccctcacgggactctttgctgagagcaagcatgctgccctcctctacaccgtgaccttccttcttttcttgatggccctcactgggaatgccctcctcatcctcctcatccactcagagccccgcctccacacccccatgtacttcttcatcagccagctcgcgctcatggatctcatgtacctatgcgtgactgtgcccaagatgcttgtgggccaggtcactggagatgataccatttccccgtcaggctgtgggatccagatgttcttccacctgaccctggctggagctgaggttttcctcctggctgccatggcctatgaccgatatgctgctgtttgcagacctctccattacccactgctgatgaaccagagggtgtgccagctcctggtgtcagcctgctgggttttgggaatggttgatggtttgttgctcacccccattaccatgagcttccccttttgccagtctaggaaaatcctgagttttttctgtgagactcctgccctgctgaagctctcctgctctgacgtctccctctataagatgctcacgtacctgtgctgcatcctcatgcttctcacccccatcatggtcatctccagctcatacaccctcatcctgcatctcatccacaggatgaattctgccgccggccgcaggaaggccttggccacctgctcctcccacatgatcatagtgctgctgctcttcggtgcttccttctacacctacatgctccggagttcctaccacacagctgagcaggacatgatggtgtctgccttttacaccatcttcactcctgtgctgaaccccctcatttacagtctccgcaacaaagatgtcaccagggctctgaggagcatgatgcagtcaagaatgaaccaagaaaagtagtaaaggacaagcattgtcccctcctctttctataattccgttactccctatctctcctctcttttgccctcaggtctccg

SEQ ID NO: 4444 - DNA, 972 bp, Homo sapiens
atgggcatggagggtcttctccagaactccactaacttcgtcctcacaggcctcatcacccatcctgccttccccgggcttctctttgcagtagtcttctccatctttgtggtggctataacagccaacttggtcatgattctgctcatccacatggactcccgcctccacacacccatgtacttcttgctcagccagctctccatcatggataccatctacatctgtatcactgtccccaagatgctccaggacctcctgtccaaggacaagaccatttccttcctgggctgtgcagttcaaatcttctacctgaccctgattggaggggaattcttcctgctgggtctcatggcctatgaccgctatgtggctgtgtgcaaccctctacggtaccctctcctcatgaaccgcagggtttgcttattcatggtggtcggctcctgggttggtggttccttggatgggttcatgctgactcctgtcactatgagtttccccttctgtagatcccgagagatcaatcactttttctgtgagatcccagccgtgctgaagttgtcttgcacagacacgtcactctatgagaccctgatgtatgcctgctgcgtgctgatgctgcttatccctctatctgtcatctctgtgtcctacacgcacatcctcctgactgtccacaggatgaactctgctgagggccggcgcaaagcctttgctacgtgttcctcccacattatggtggtgagcgttttctacggggcagccttctacaccaacgtgctgccccactcctaccacactccagagaaagataaagtggtgtctgccttctacaccatcctcacccccatgctcaacccactcatctacagcttgaggaataaagatgtggctgcagctctgaggaaagtactagggagatgtggttcctcccagagcatcagggtggcgactgtgatcaggaagggctag

SEQ ID NO: 4445 - DNA, 1047 bp, Homo sapiens
atggacaacatcacctggatggccagccacactggatggtcggatttcatcctgatgggactcttcagacaatccaaacatccaatggccaatatcacctggatggccaaccacactggatggtcggatttcatcctgttgggactcttcagacaatccaaacatccagcactactttgtgtggtcatttttgtggttttcctgatggcgttgtctggaaatgctgtcctgatccttctgatacactgtgacgcccacctccacacccccatgtactttttcatcagtcaattgtctctcatggacatggcgtacatttctgtcactgtgcccaagatgctcctggaccaggtcatgggtgtgaataagatctcagcccctgagtgtgggatgcagatgttcttctacgtgacactagcaggttcagaatttttccttctagccaccatggcctatgaccgctacgtggccatctgccatcctctccgttaccctgtcctcatgaaccatagggtgtgtctcttcctgtcatcaggctgctggttcctgggctcagtggatggcttcacattcactcccatcaccatgaccttccccttccgtggatcccgggagattcatcatttcttctgtgaagttcctgctgtattgaatctctcctgctcagacacctcactctatgagattttcatgtacttgtgctgtgtcctcatgctcctcatccctgtggtgatcatttcaagctcctatttactcatcctcctcaccatccacgggatgaactcagcagagggccggaaaaaggcctttgccacctgctcctcccacctgactgtggtcatcctcttctatggggctgccatctacacctacatgctccccagctcctaccacacccctgagaaggacatgatggtatctgtcttctataccatcctcactccagtggtgaaccctttaatctatagtcttaggaataaggatgtcatgggggctctgaagaaaatgttaacagtggaacctgcctttcaaaaagctatggagtag

SEQ ID NO: 4446 - DNA, 1014 bp, Homo sapiens
acctcatggccaacatcaccaggatggccaaccacactggaaagttggatttcatcctcatgggactcttcagacgatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcaga

SEQ ID NO: 4447 - DNA, 927 bp, Homo sapiens
atgaatgaaaacaatgaaaccttgaccagaggctttaccctcatggggctcttcactcacaataaatgctcaggattctttttcggtgtcatttgtgccgtcttcttcatggccatgatagctaatggggtcatgatcttcctgattaacatagaccctcatctccacacccccatgtacttcctcctcagccacctctccgtcattgacacattatacatctccaccattgtgcccaagatgctggtagattatctcatgggcgaggggaccatctctttcatcgcctgcactgctcagtgctttctctacatgggctttatgggggctgaattcttcctgctggggctcatggcctatgaccgctacgtggccatctgcaacccactgcgctatcctgtcctcatcagctggcgggtctgctggatgatcctggccagctcttggttcggtggggctttggacagttttctcctcacccccattaccatgagtctcccgttctgtgcctctcaccaaatcaatcactttttctgtgaggcacccaccatgctgaggctggcctgtggggacaaaaccacctatgaaacagtgatgtatgtgtgctgcgttgcaatgctgctgatccccttctcggtggtgactgcatcctacaccaggattctcatcacagtgcatcagatgacatcggctgaagggaggaagaaggcctttgccacctgctcttcacacatgatggtggtgacattgttctatggggctgccttgtatacgtatacgcttccccaatcttaccacaccccaatcaaagataaggtcttctctgccttttataccatcctcacacccttattaaaccctctcatctacagtctgaggaacagggatgtgatgggtgccttgaagagagttgtggcaagatgttag

SEQ ID NO: 4448 - DNA, 948 bp, Homo sapiens
atgggaagatgggtgaaccagtcctacacagatggcttcttcctcttgggcatcttttcccacagccagactgaccttgtcctcttctctgcagttatggtggtcttcacagtggccctctgtgggaatgtcctcctcatcttcctcatctacctggacgctggacttcacacccccatgtacttcttcctcagccagctctccctcatggacctcatgttggtctgtaacattgtgccaaagatggcagccaacttcctgtctggcaggaagtccatctcctttgtgggctgtggcatacaaattggcttttttgtctctcttgtgggatctgaggggctcttgctgggactcatggcttatgaccgctacgtggccgttagccacccacttcactatcccatcctcatgaatcagagggtctgtctccagattactgggagctcctgggcctttgggataatagatggagtgattcagatggtggcagccatgggcttaccttactgtggctcaaggagcgtggatcactttttctgtgaggtacaagctttattgaagctggcctgtgcagacacttccctttttgacaccctcctctttgcttgctgtgtcttcatgcttctccttcccttctccatcatcatggcctcctatgcttgcatcctaggggctgtgctccgaatacgctctgctcaggcctggaaaaaagccctggccacctgctcctcccacctaacagctgtcaccctcttctatggggcagccatgttcatgtacctgaggcctaggcgctaccgggcccctagccatgacaaggtggcctctatcttctacacagtccttactcccatgctgaaccccctcatttacagcttgaggaatggggaggtgatgggggcactgaggaaggggctggaccgctgcaggattggcagccagcactga

SEQ ID NO: 4449 - DNA, 948 bp, Homo sapiens
atggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactga

SEQ ID NO: 4450 - DNA, 1028 bp, Homo sapiens
ccttgtatcatcatctacctcctcctcctccttttctcactctaggatttagacattgaaggactatggaccaaagcaattatagttctttacatggttttattctgcttggcttctctaaccatccaaaaatggagatgatcctgtcaggagttgtcgccatcttctacttaattacattggtgggtaacacagccatcattcttgcatctctcctggattcccagcttcatacaccaatgtactttttcctcagaaatttatctttcctagatctatgtttcacaaccagcatcatccctcagatgctggtcaacttgtggggacctgataagaccatcagctatgtgggttgtatcatccaactctatgtttacatgtggttgggctcagttgagtgccttctcctggctgttatgtcctatgatcgttttacagctatatgtaagcccttgcattattttgtagtcatgaacccacatctatgtctaaagatgattatcatgatctggagtattagtttggccaattctgtagtattatgtacactcactctgaatttgcccacatgtggaaacaacattctggatcatttcttgtgtgagttgccagctctggtcaagatagcttgtgtagacaccacaacagttgaaatgtctgttttcgctttaggcattataattgtcctcacacctctcatccttattcttatatcctatggctacattgccaaagctgtgctgagaacgaagtcaaaagcaagccagcgaaaagcaatgaatacctgtggatctcatcttactgtagtgtctatgttctatggaactattatctacatgtacctgcaaccaggtaacagggcttccaaagaccagggcaagttcctcaccctcttttacaccgtcatcactccaagtctcaacccgctcatttacaccttaagaaataaggacatgaaggatgccctgaagaaactgatgagatttcaccacaaatctacaaaaataaagaggaattgcaagtcatag

SEQ ID NO: 4451 - DNA, 1028 bp, Homo sapiens; identical to SEQ ID NO: 4450

SEQ ID NO: 4452 - DNA, 1028 bp, Homo sapiens; identical to SEQ ID NO: 4450

SEQ ID NO: 4453 - DNA, 1028 bp, Homo sapiens; identical to SEQ ID NO: 4450

SEQ ID NO: 4454 - DNA, 1028 bp, Homo sapiens; identical to SEQ ID NO: 4450

SEQ ID NO: 4455 - DNA, 1028 bp, Homo sapiens; identical to SEQ ID NO: 4450

SEQ ID NO: 4456 - DNA, 1028 bp, Homo sapiens; identical to SEQ ID NO: 4450

SEQ ID NO: 4457 - DNA, 1028 bp, Homo sapiens; identical to SEQ ID NO: 4450

SEQ ID NO: 4458 - DNA, 945 bp, Homo sapiens
atggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaa

SEQ ID NO: 4459 - DNA, 1818 bp, Homo sapiens
cacaaggctggaagcagagaacatccccatggaactgaagacagcatgctgcatccctgggaggagggagctcttaaggaagttccaagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggattgatatttctgttcagcagcagtagagatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaaaggcatctccacctgacttcacttccatccagggccactggcagcatctggaacggctgaattccagctgatattagcccacgactcccaacttgcctttttctggacttttgtgaggctgtttcagttctgacattatgtgtttttgttgttgctcttaaaattgagacggggtctcactctgtcacctagggtagagtgcagtggtgccaccatagctccttcgactattgggcttaagcgatcctcccccacctcagccttccaagtaactgggactacaggtgtgcatcactggcagtgggaattgtggcttgtggcttttctgtcttctatggagacggggtcttgctgtgttgaccaggctggtcccaaactcctggcctcatgtgatccccctgccatggcctcctaaaagttctgggattacaagtgtgagtcactgcgactggccaacattatgtgatttatgtgtgaactatataacacaaatcatccccaaaacccatcatgatctgtaaagcagctgcaaagaatgaagtgagacaaacagttgtaaagatgagtttccacctacttataccagagtgctaagaggaaataactcttctcaatc

SEQ ID NO: 4460 - DNA, 1058 bp, Homo sapiens
ggcattgcacttccttctgctgttcagacaggcaaaaggccatgggaagtttcaacaccagttttgaagatggcttcattttggtgggattctcagattggccgcaactggagcccatcctgtttgtctttatttttattttctactccctaactctctttggcaacaccatcatcatcgctctctcctggctagaccttcggctgcacacacctatgtacttctttctctctcatctgtccctcctggacctctgcttcaccaccagcaccgtgccccagctcctgatcaacctttgcggggtggaccgcaccatcacccgtggagggtgtgtggctcagctcttcatctacctagccctgggctccacagagtgtgtgctcctggtggtgatggcctttgaccgctatgctgctgtctgtcgtccactccactacatggccatcatgcacccccatctctgccagaccctggctatcgcctcctggggtgcgggtttcgtgaactctctgatccagacaggtctcgcaatggccatgcctctctgtggccatcgactgaatcacttcttctgtgagatgcctgtatttctgaagttggcttgtgcggacacagaaggaacagaggccaagatgtttgtggcccgagtcatagtcgtggctgttcctgcagcacttattctaggctcctatgtgcacattgctcatgcagtgctgagggtgaagtcaacggctgggcgcagaaaggcttttgggacttgtgggtcccacctcctagtagttttccttttttatggctcagccatctacacatatctccaatccatccacaattattctgagcgtgagggaaaatttgttgcccttttttatactataattacccccattctcaatcctctcatttatacactaagaaacaaggacgtgaagggggctctgtggaaagtactatggaggggcagggactcagggtaggaggtgaaaaaatgagcagtaaaattttctgtaatagctcttcaatcacagatctttccctgttccttggagggcagttgg

SEQ ID NO: 4461 - DNA, 1056 bp, Homo sapiens
ttatttgccaccccatgcaggcttcttgccatagttcagctgttcttcctgcagctaaagtgcattgtgtaaaacatgggggatgtgaatcagtcggtggcctcagacttcattctggtgggcctcttcagtcactcaggatcacgccagctcctcttctccctggtggctgtcatgtttgtcataggccttctgggcaacaccgttcttctcttcttgatccgtgtggactcccggctccatacacccatgtacttcctgctcagccagctctccctgtttgacattggctgtcccatggtcaccatccccaagatggcatcagactttctgcggggagaaggtgccacctcctatggaggtggtgcagctcaaatattcttcctcacactgatgggtgtggctgagggcgtcctgttggtcctcatgtcttatgaccgttatgttgctgtgtgccagcccctgcagtatcctgtacttatgagacgccaggtatgtctgctgatgatgggctcctcctgggtggtaggtgtgctcaacgcctccatccagacctccatcaccctgcattttccctactgtgcctcccgtattgtggatcacttcttctgtgaggtgccagccctactgaagctctcctgtgcagatacctgtgcctacgagatggcgctgtccacctcaggggtgctgatcctaatgctccctctttccctcatcgccacctcctacggccacgtgttgcaggctgttctaagcatgcgctcagaggaggccagacacaaggctgtcaccacctgctcctcgcacatcacggtagtggggctcttttatggtgccgccgtgttcatgtacatggtgccttgcgcctaccacagtccacagcaggataacgtggtttccctcttctatagccttgtcacccctacactcaacccccttatctacagtctgaggaatccggaggtgtggatggctttggtcaaagtgcttagcagagctggactcaggcaaatgtgctgactacatagaaactgctggtgagattccagcggtcct

SEQ ID NO: 4462 - DNA, 948 bp, Homo sapiens
atgcagccagaatctggggccaatggaacagtcattgctgagttcatcctgctgggcttgctggaggcgccagggctgcagccagttgtctttgtgctcttcctctttgcctacctggtcacggtcaggggcaacctcagcatcctggcagctgtcttggtggagcccaaactccacacccccatgtacttcttcctggggaacctatcagtgctggatgttgggtgcatcagcgtcactgttccatcaatgttgagtcgtctcctgtcccgcaagcgtgcagttccctgtggggcctgccttacccagctcttcttcttccatctgttcgttggagtggactgcttcctgctgaccgccatggcctatgaccgattcctggccatctgccggcccctcacctacagcacccgcatgagtcagacagtccagaggatgttggtggctgcgtcctgggcttgtgctttcaccaacgcactgacccacactgtggccatgtccacgctcaacttctgtggccccaatgtgatcaatcacttctactgtgacctcccacagctcttccagctctcctgctccagcacccaactcaatgagctgctgctttttgctgtgggttttataatggcaggtacccccatggctctcattgtcatctcctatatccacgtggcagctgcagtcctgcgaattcgctctgtagagggcaggaagaaagccttctccacatgtggctcccacctcactgtggttgccatattctatggttcaggtatctttaactatatgcgactgggttcaaccaagctttcagacaaggataaagctgttggaattttcaacactgtcatcaatcccatgctgaacccaatcatctacagcttcagaaaccctgatgtgcagagtgccatctggaggatgctcacagggaggcggtcactggcttga

SEQ ID NO: 4463 - DNA, 1076 bp, Homo sapiens
taagtgaactgagtgaactgatacctcccctgctgggacatgtccttacagaaactcatggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtccttggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgctgtgggtttcatcatggcaggcacacctttggttctcatcatcactgcctacagccacgtggcagctgcagttctacgaatccgttcagtggagggccgaaagaaggccttctccacgtgtggctcccacctcaccgtggtttgtcttttctttggaagaggtatcttcaactacatgagactgggttcagaggaggcttcagacaaggataaaggggttggagttttcaacactgttatcaaccctatgctgaaccctcttatctacagcctcagaaaccctgatgttcagggtgctctgtggcaaatatttttggggaggagatcactgacctgagaggtaatggggtccctcctttcctgccttttctggactgaggaaaatttcccatgaagacagtaaccagg

SEQ ID NO: 4464 - DNA, 966 bp, Homo sapiens
atgtccttacagaaactcatggagccagaagctgggaccaataggaccgctgttgctgagttcattctactgggcctagtgcaaacagaagagatgcagccagttgtctttgtgctcctcctctttgcctatctggtcacaactgggggcaacctcagcatcctggcagccgtcttggtggagcccaaactccacgcccccatgtacttcttcctggggaacctgtcagtgctggatgtcggatgtatcactgtcactgttcctgcaatgttgggtcgtctcttgtcccacaagtccacaatttcctatgacgcctgcctctcccagctcttcttcttccaccttctggctgggatggactgcttcctgctgaccgccatggcctatgaccgactcctggccatctgccagcccctcacctacagcacccgcatgagtcagacagtccagaggatgttggtggctgcgtcctgggcttgtgccttcaccaacgcactgacccacactgtggccatgtccacgctcaacttctgtggccccaatgaggtcaatcacttctactgtgacctcccacagctcttccagctctcctgctccagcacccaactcaatgagctgctgctctttgtagcagcagccttcatggctgtggcacccttggtcttcatcagtgtgtcctatgcccatgtggtagctgctgtgctgcaaatccgctctgctgagggcagaaagaaggccttctccacatgtggctcccacctcactgtggtgggcatcttctatgggacaggtgtcttcagctacatgaggctgggttcagtggaatcttcagacaaggataagggggttggggttttcatgactgtgatcaaccccatgctgaacccacttatctacagcctcagaaatactgatgttcagggcgctctgtgtcagctacttgtggggaagcgatcactgacctga

SEQ ID NO: 4465 - DNA, 1035 bp, Homo sapiens
atggagcttctgacaaataatctcaaatttatcactgacccttttgtttgtaggctccgacacctgagtccaacaccttcagaagaacacatgaaaaataagaacaatgtgactgaatttatcctcttagggctcacacagaaccctgaggggcaaaaggttttatttgtcacattcttactaatctacatggtgacgataatgggcaacctgcttatcatagtgaccatcatggccagccagtccctgggttcccccatgtacttttttctggcttctttatcattcatagataccgtctattctactgcatttgctcccaaaatgattgttgacttgctctctgagaaaaagaccatttcctttcagggttgtatggctcaactttttatggatcatttatttgctggtgctgaagtcattcttctggtggtaatggcctatgatcgatacatggccatctgtaagcctcttcatgaattgatcaccatgaatcgtcgagtctgtgttcttatgctgttggcggcctggattggaggctttcttcactcattggttcaatttctctttatttatcagctccctttctgtggacccaatgtcattgacaacttcctgtgtgatttgtatcccttattgaaacttgcttgcaccaatacctatgtcactgggctttctatgatagctaatggaggagcgatttgtgctgtcaccttcttcactatcctgctttcctatggggtcatattacactctcttaagactcagagtttggaagggaaacgaaaagctttctacacctgtgcatcccacgtcactgtggtcattttattctttgtcccctgtatcttcttgtatgcaaggcccaattctacttttcccattgataaatccatgactgtagttctaacttttataactcccatgctgaacccactaatctataccctgaagaatgcagaaatgaaaagtgccatgaggaaactttggagtaaaaaagtaagcttagctgggaaatggctgtatcactcatga

SEQ ID NO: 4466 - DNA, 1081 bp, Homo sapiens
ccctgttctcctgagctctcatttctgatataagcttgaaagaagagtaaatgagaccaagcagcaatgttacagaatttgtcctcctgggcctcactcaagatcctgatgtgaaaaaaacattatttgtcatgtttttactcatatacattgtgacaatggtgggaaacctcctcatttgggtgactactattggcagcccctccttgggctccctaatgtacttcttccttgcctacttgtcacttatggatgccatatattccactgccatgtcacccaaattgatgatagacttactctgtgataaaatcgctatttccttgtcagcttgcatgggtcagctcttcatagaacacttacttggtggtgcagaggtcttccttttggtggtgatggcctatgatcgctatgtggctatctctaagccgctgcactatttgaacatcatgaatcgactggtttgcatccttctgttggtggtggccatgattggaggttttgtgcactctgtggttcaaattgtctttctgtacagtctaccaatctgtggccccaatgttattgaccactctgtctgtgacatgtacccattgttggaactgttgtgccttgacacctactttataggactcactgtggttgccaatggtggaataatttgtatggtcatctttacctttctgctaatctcctgtggagtcatcctaaacttccttaaaacttacagtcaggaagagaggcataaagccctgcctacctgcatctcccacatcattgtggttgccctcgtttttgttccctgtatttttatgtatgttagacccgtttccaactttccctttgataaattaatgactgtgttttattcaattatcacactcatgttgaatcctttaatatactcgttgagacaatcagagatgaaaaatgctatgaaaaatctctggtgtgaaaagttaagtatagttagaaaaagagtatctcccacactgaacatatttattcctagttctaaggcaacaaataggcggtaaaatactgcagtcaattcaacagattctgtagggatgcttctctc

SEQ ID NO: 4467 - DNA, 1064 bp, Homo sapiens
tgcatttaaagatttccccccttgttttataggtaaactgcttatatgatctgaagtaagcagctgtaaagaatacatggagccaaggaaaaatgtgactgactttgtcctcttgggcttcacacagaatccaaaggagcagaaagtactttttgttatgttcttgctcttctacattttgaccatggtgggcaacctgctcattgtagtgaccgtaactgtcagtgagaccctgggctcaccaatgtacttctttcttgctggcttatcatttatagatatcatttattcttcatccatttcccccagattgatttcaggcttgttctttgggaataattccatatccttccaatcttgcatggcccagctctttatcgagcacattttcggtgggtcagaggtctttctcctgttggtgatggcctatgactgctatgtggccatctgtaagcccttgcattatttggttatcatgagacaatgggtgtgtgttgtgctgctggtagtgtcctgggttggaggatttctgcactcagtatttcaacttagcattatttatgggctcccattctgtggccccaatgtcattgatcattttttctgtgacatgtatcccttattgaaactggtctgcactgacacccatgctattggcctcttagtggtggccaatggaggactggcttgcactattgtgtttctgctcttactcatctcttatggtgtcatcttgcactctttaaagaaccttagtcagaaagggaggcaaaaagccctctcaacctgcagttcccacatgactgtggttgtcttcttctttgttccttgtatttttatgtatgctagacctgctaggaccttccccattgacaaatcagtgagtgtgttttatacagtcataaccccaatgctgaaccccttaatctacactctgagaaattctgagatgacaagtgctatgaagaagctctggagaagagacctcatatcaagtagtacataagtgagttacccaccaggaagagagtcatttgactttacagcctttctccttgggaccc

SEQ ID NO: 4468 - DNA, 1071 bp, Homo sapiens
aggccctgtttccctgagctctcacctctgatacaagccttaaagaagagtaaatgagacagaataacaatattacagaatttgtcctcctgggcttttctcaggatcctggtgtgcaaaaagcattatttgtcatgtttttactcacatacttggtgacagtggtggggaacctgctcattgtggtggatattattgccagcccttccttgggttccccaatgtatttcttccttgcctgcctgtcatttatagatgctgcatattccactaccatttctcccaagttaattgtaggcttattctgtgataaaaagactatttccttccaaggttgcatgggccagctatttatagaccatttctttggtggggctgaggtcttccttctggtggtgatggcctgtgatcgctatgtggccatctgtaagccactgcactatttgaccatcatgaatcgacaggtttgcttccttctgttggtggtggccatgattggaggttttgtacattctgcgtttcaaattgttgtgtacagtctccctttctgtggtcccaatgtcattgttcatttcagttgtgacatgcacccattactggaactggcatgcactgacacctactttataggcctcactgttgttgtcaatagtggagcaatctgtatggtcattttcaaccttctgttaatctcctatggagtcatcctaagctcccttaaaacttacagtcaggaaaagaggggtaaagccttgtctacctgcagctccggcagtaccgttgttgtcctcttttttgtaccctgtattttcatatatgttagacctgtttcaaactttcctactgataagttcatgactgtgttttataccattatcacacacatgctgagtcctttaatatatacgttgagaaattcagagatgagaaatgctatagaaaaactcttgggtaaaaagttaactatatttattataggaggagtgtccgtcctcatgtaggtaaggaggtatgtagtcaaggtcttcccagtgaagttttcaggtttctaagggcaagtcaaggatccca

SEQ ID NO: 4469 - DNA, 971 bp, Homo sapiens
cttctctgagtggaatccatggccagtacaagtaatgtgactgagttgattttcactggccttttccaggatccagctgtgcagagtgtatgctttgtggtgtttctccccgtgtaccttgccacggtggtgggcaatggcctcatcgttctgacggtcagtatcagcaagagtctggattctcccatgtacttcttccttagctgcctgtccttggtggagatcagttattcctccactatcgcccctaaattcatcatagacttacttgccaagattaaaaccatctctctggaaggctgtctgactcagatattcttcttccacttctttggggttgctgagatccttttgattgtggtgatggcctatgattgctacgtggccatttgcaagcctcttcattatatgaacattatcagtcgtcaactgtgtcaccttctggtggctggttcctggctggggggcttttgtcactccataattcagattctcgttatcatccaattgcccttctgtggtcccaatgtgattgaccactatttctgtgacctccagcctttattcaagcttgcctgcactgacaccttcatggagggggttattgtgttggccaacagtggattattctctgtcttctccttcctcatcttggtgtcctcttatattgtcattctggtcaacttgaggaaccattctgcagaggggaggcacaaagccctctccacctgtgcttctcacatcacagtggtcatcttgttttttggacctgctatcttcctctacatgcgaccttcttccactttcactgaagataaacttgtggctgtattctacacggtcatcacccccatgctgaaccccatcatttacacactcaggaatgcagaggtgaaaatcgccataagaagattgtggagcaaaaaggagaatccagggagggagtgaaaaaagagcttagggatgaaaaa

SEQ ID NO: 4470 - DNA, 1045 bp, Homo sapiens
tggtttcttcacatcaactgaaacaatgcagcaaaataacagtgtgcctgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaacaccctttctcaatccactcatctacacactgaggaatgcagaagtgaaaaatgccatgagaaagttatggcatggcaaaattatttcagaaaacaaaggataaattgagggcctgacctgattactttttcagtcaaatcatgatttaacagagtaagtatagacagcaaataggaaagtacctgaatgc

SEQ ID NO: 4471 - DNA, 1063 bp, Homo sapiens
ccttcctggaggttttatcacccacactacatagatggagaagaaaaagaatgtgactgaattcattttaataggtcttacacagaaccccataatggagaaagtcacgtttgtagtatttttggttctttacatgataacactttcaggcaacctgctcattgtggttaccattaccaccagccaggctctgagctcccccatgtacttcttcctgacccacctttctttgatagacacagtttattcttcttcttcagctcctaagttgattgtggattcctttcaagagaagaaaatcatctcctttaatgggtgtatggctcaagcctatgcagaacacatttttggtgctactgagatcatcctgctgacagtgatggcctgtgactgctatgtggccatctgcaaacctctgaactacacaaccattatgagccacagcctgtgcattctcctggtggcagtggcctgggtgggaggatttcttcatgcaactattcagattctctttacagtatggctgcccttctgtggccccaatgtcataggccacttcatgtgtgacttgtacccattgttaaaacttgtttgcatagacactcatacccttggtctctttgttgctgtgaacagtgggtttatctgcttattaaacttccttatcttggtggtatcctatgtgatcatcttgagatctttaaagaacaatagcttggaggggaggtgtaaagccctctccacctgtatttctcacatcatagtagttgtcttattctttgtgccctgtatatttgtgtatctgcgctcagtgaccactctgcccattgataaagctgttgctgtattttatactatggtggtcccaatgttaaatcccgtggtctacacactcagaaatgctgaggtaaaaagtgcaataaggaagctttggagaaaaaaagtgacttcagataatgattaaataagaccattgagcactcaacatagaggtaataggtatttaagcttcttgatttgtagatgaatatgtcaactctaacaaggggctggctaatgcttg

SEQ ID NO: 4472 - DNA, 1029 bp, Homo sapiens
caggtaatgtaattaaccatcatttgaaatacatggcgaatagaaacaatgtgacagagtttattctattggggcttacagagaatccaaaaatgcagaaaatcatatttgttgtgttttctgtcatctacatcaacgccatgataggaaatgtgctcattgtggtcaccatcactgccagcccatcactgagatcccccatgtactttttcctggcctatctctcctttattgatgcctgctattcctctgtcaatacccctaagctgatcacagattcactctatgaaaacaagactatcttattcaatggatgtatgactcaagtctttggagaacattttttcagaggtgttgaggtcatcctacttactgtaatggcctatgaccactatgtggccatctgcaagcccttgcactataccaccgtcatgaagcagcatgtttgtagcctgctagtgggagtgtcatgggtaggaggctttcttcatgcaaccatacagatcctcttcatctgtcaattacctttctgtggtcctaatgtcatagatcactttatgtgtgatctctacactttgatcaatcttgcctgcactaatacccacactctaggactcttcattgctgccaacagtgggttcatatgcctgttaaactgtctcttgctcctggtctcctgcgtggtcatactgtactccttaaagacccacagcttagaggcaaggcacgaagccctctctacctgtgtctcccacatcacagttgtcatcttatcctttataccctgcatatttgtgtacatgagacctccagctactttacccattgataaagcagttgctgtattctacactatgataacttctatgttaaaccccttaatctacaccttgaggaatgctcaaatgaaaaatgccattaggaaattgtgtagtaggaaagctatttcaagtgtcaaataaatgtgactggagcccaacatgattcagctgaggcaagggtcaaaaggacattttgggtaatgccagc

SEQ ID NO: 4473 - DNA, 1113 bp, Homo sapiens
atgttctcaatgacaacagaagcactcaataattttgcacttggatgtaccaacttgttaatgactatgataccacaaattgatctgaagcaaattttcctttgtcctaattgcagactatacatgatccctgttggagctttcatcttttccttgggaaacatgcaaaaccaaagctttgtaactgagtttgtcctcctgggactttcacagaatccaaatgttcaggaaatagtatttgttgtatttttgtttgtctacattgcaactgttgggggcaacatgctaattgtagtaaccattctcagcagccctgctcttctggtgtctcctatgtacttcttcttgggcttcctgtccttcctggatgcgtgcttctcatctgtcatcaccccaaagatgattgtagactccctctatgtgacaaaaaccatctcttttgaaggctgcatgatgcagctctttgctgaacacttctttgctggggtggaggtgattgtcctcacagccatggcctatgatcgttatgtggccatttgcaagcccttgcattactcttctatcatgaacaggaggctctgtggcattctgatgggggtagcctggacagggggcctcttgcattccatgatacaaattctttttactttccagcttcccttttgtggccccaatgtcatcaatcactttatgtgtgacttgtacccgttactggagcttgcctgcactgatactcacatctttggcctcatggtggtcatcaacagtgggtttatctgcatcataaacttctccttgttgcttgtctcctatgctgtcatcttgctctctctgagaacacacagttctgaagggcgctggaaagctctctccacctgtggatctcacattgctgttgtgattttgttctttgtcccatgcatatttgtatatacacgacctccatctgctttttcccttgacaaaatggcggcaatattttatatcatcttaaatcccttgctcaatcctttgatttacactttcaggaataaggaagtaaaacaggccatgaggagaatatggaacagactgatggtggtttctgatgagaaagaaaatattaaactttaa

SEQ ID NO: 4474 - DNA, 933 bp, Homo sapiens
atgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccttgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataa

SEQ ID NO: 4475 - DNA, 1036 bp, Homo sapiens
aacttgcaatgtttttcccccatgcaattagttctattacttatgtttctccttgtctttataggcaatactgcacctgcattctcagtgaccttggaatctatggacataccacaaaatatcacagaatttttcatgctggggctctcacagaactcagaggtacagagagttctctttgtggtctttttgctgatctatgtggtcacggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaagaaattgcaggtggaaaatgagtgg

SEQ ID NO: 4476 - DNA, 600 bp, Homo sapiens
attctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaataatacaatcaaacacttctggaagcatatcctggaagaggataaaaca

SEQ ID NO: 4477 - DNA, 981 bp, Homo sapiens
atgtatgtgtcaaattgcaatccttgtgctattcacagaaaaatcaattatccaaataccaaactggatttcgagcaagtgaacaacataacggaattcatcttgcttggcctgacacagaacgcagaggcacagaaactcttgtttgctgtgtttacactcatctactttctcaccatggtagacaacctaatcattgtggtgacaatcaccaccagcccagccctggactcccccgtgtatttttttctgtctttcttttccttcatagatggctgctcctcttctaccatggcccccaaaatgatatttgacttactcactgaaaagaaaactatttccttcagtgggtgcatgacccagctctttgtagaacatttctttgggggagttgagatcattctgctcgtggtgatggcctatgactgctatgtggccatctgcaagcccctgtactacctgatcacaatgaacaggcaggtatgtggcctcctggtggccatggcatgggtcgggggatttcttcacgctctgattcaaatgcttttaatagtctggctgcccttctgtggccccaatgtcattgaccatttcatctgtgaccttttccctctgctaaaactctcctgcactgacactcacgtctttggactctttgttgccgccaacagtgggctgatgtgtatgctcattttttctattcttattacctcttacgtcctaatcctctgctcacagcggaaggctctctctacctgcgccttccatatcactgtagtcgtcctattctttgttccctgtatattggtgtaccttcgacccatgatcaccttccctattgataaagctgtgtctgtgttttatactgtggtaacacccatgttaaaccctttaatctacaccctcagaaacacagaggtgaaaaatgccatgaagcagctctggagccaaataatctggggtaacaatttgtgtgattag

SEQ ID NO: 4478 - DNA, 1058 bp, Homo sapiens
cagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaag

SEQ ID NO: 4479 - DNA, 1024 bp, Homo sapiens
aggaacgtgggggaagatcctatggaaccacagaacaccacacaggtatcaatgtttgtcctcttagggttttcacagacccaagagctccagaaattcctgttccttctgttcctgttagtctatgttaccaccattgtgggaaacctccttatcatggtcacagtgacttttgactgccggctccacacacccatgtattttctgctccgaaatctagctctcatagacctctgctattccacagtcacctctccaaagatgctggtggacttcctccatgagaccaagacgatctcctaccagggctgcatggcccagatcttcttcttccaccttttgggaggtgggactgtcttttttctctcagtcatggcctatgaccgctacatagccatctcccagcccctccggtatgtcaccatcatgaacactcaattgtgtgtgggcctggtagtagccgcctgggtggggggctttgtccactccattgtccaactggctctgatacttccactgcccttctgtggccccaatatcctagataacttctactgtgatgttccccaagtactgagacttgcctgcactgatacctccctcctggagttcctcatgatctccaacagtgggctgctagttatcatctggttcctcctccttctgatctcttatactgtcatcctggtgatgctgaggtcccactcgggaaaggcaaggaggaaggcagcttccacctgcaccacccacatcatcgtggtgtccatgatcttcattccctgtatctatatctatacctggcccttcaccccattcctcatggacaaggctgtgtccatcagctacacagtcatgacccccatgctcaaccccatgatctacaccctgagaaaccaggacatgaaagcagccatgaggagattaggcaagtgcctagtaatttgcagggagtaaactttaagtaagttgactttaaatgacaaatttctctggatttttattttcccacatgaaaaatggagga

SEQ ID NO: 4480 - DNA, 1024 bp, Homo sapiens
tcccagtgctttcacatgacatggtttaaaaccaaagagaataaagaggatgattgaatggagatggaaaactgcaccagggtaaaagaatttattttccttggcctgacccagaatcgggaagtgagcttagtcttatttcttttcctactcttggtgtatgtgacaactttgctgggaaacctcctcatcatggtcactgttacctgtgaatctcgccttcacacgcccatgtattttttgctccataatttatctattgccgatatctgcttctcttccatcacagtgcccaaggttctggtggaccttctgtctgaaagaaagaccatctccttcaatcattgcttcactcagatgtttctattccaccttattggaggggtggatgtattttctctttcggtgatggcattggatcgatatgtggccatctccaagcccctgcactatgcgactatcatgagtagagaccattgcattgggctcacagtggctgcctggttggggggctttgtccactccatcgtgcagatttccctgttgctcccactccctttctgcggacccaatgttcttgacactttctactgtgatgtccaccgggtcctcaaactggcccatacagacattttcatacttgaactactaatgatttccaacaatggactgctcaccacactgtggtttttcctgctcctggtgtcctacatagtcatattatcattacccaagtctcaggcaggagagggcaggaggaaagccatctccacctgcacctcccacatcactgtggtgaccctgcatttcgtgccctgcatctatgtctatgcccggcccttcactgccctccccatggataaggccatctctgtcaccttcactgtcatctcccctctgctcaaccccttgatctacactctgaggaaccatgagatgaagtcagccatgaggagactgaagagaagacttgtgccttctgatagaaaatagaaaaaaaaatcctcagctcttcatcaccaaa

SEQ ID NO: 4481 - DNA, 936 bp, Homo sapiens
atggagttgggaaatgtcaccagagtaaaagaatttatatttctgggacttactcaatcccaagaccagagtttggtcttgtttctttttttatgtcttgtgtacatgacgactctgctgggaaacctcctcatcatggtcaccgtgacctgtgagtctcgccttcacacccccatgtacttcctgctccgcaatctagccatccttgacatctgcttctcctccacaactgctcctaaagtcttgctggaccttctgtcaaagaaaaagaccatatcctatacaagctgcatgacacagatatttctcttccacctccttggtggggcagacattttttctctctctgtgatggcgtttgactgctacatggccatctccaagcccctgcactatgtgaccatcatgagtagagggcaatgcactgccctcatctctgcctcttggatggggggctttgtccactccatcgtgcagatctccctgttgctgcctctccctttctgtggacccaatgttcttgacactttctactgcgatgtcccccaggtcctcaaactcacttgcactgacacttttgctcttgagttcttgatgatttccaacaatggcctggtcactaccctgtggtttatcttcctgcttgtgtcctacacagtcatcctaatgacgctgaggtctcaggcaggagggggcaggaggaaagccatctccacttgcacctcccacatcactgtggtgaccctgcattttgtgccctgcatctatgtctatgcccggcccttcactgccctccccacagaaaaggccatctctgtcaccttcactgtcatctcccctctgctgaaccctttgatctacactctgaggaaccaggaaatgaagtcagccatgagaagactgaagagaagactcgtgccttctgaaagggaatag

SEQ ID NO: 4482 - DNA, 924 bp, Homo sapiens
atggaaacagggaacctcacgtgggtatcagactttgtcttcctggggctctcgcagactcgggagctccagcgtttcctgtttctaatgttcctgtttgtctacatcaccactgttatgggaaacatccttatcatcatcacagtgacctctgattcccagctccacacacccatgtactttctgctccgaaacctggctgtcctagacctctgtttctcttcagtcactgctcccaaaatgctagtggacctcctctctgagaagaaaaccatctcttaccagggctgcatgggtcagatcttcttcttccactttttgggaggtgccatggtcttcttcctctcagtgatggcctttgaccgcctcattgccatctcccggcccctccgctatgtcaccgtcatgaacactcagctctgggtggggctggtggtagccacctgggtgggaggctttgtccactctattgtccagctggctctgatgctcccactgcccttctgtggccccaacattttggataacttctactgtgatgttccccaagtactgagacttgcctgcactgacacctcactgctggagttcctcaagatctccaacagtgggctgctggatgtcgtctggttcttcctcctcctgatgtcctacttattcatcctggtgatgctgaggtcacatccaggggaggcaagaaggaaggcagcttccacctgcaccacccacatcatcgtggtttccatgatcttcgttccaagcatttacctctatgcccggcccttcactccattccctatggacaagcttgtgtccatcggccacacagtcatgacccccatgctcaaccccatgatctataccctgaggaaccaggacatgcaggcagcagtgagaagattagggagacaccggctggtttga

SEQ ID NO: 4483 - DNA, 1095 bp, Homo sapiens
gagaactttgcagatcccctgaataatatgtccttttttcttagcaggttcattgacaaggtcataccaaccagatgaatccagcaaatcattcccaggtggcaggatttgttctactggggctctctcaggtttgggagcttcggtttgttttcttcactgttttctctgctgtgtattttatgactgtagtgggaaaccttcttattgtggtcatagtgacctccgacccacacctgcacacaaccatgtattttctcttgggcaatctttctttcctggacttttgctactcttccatcacagcacctaggatgctggttgacttgctctcaggcaaccctaccatttcctttggtggatgcctgactcaactcttcttcttccacttcattggaggcatcaagatcttcctgctgactgtcatggcgtatgaccgctacattgccatttcccagcccctgcactacacgctcattatgaatcagactgtctgtgcactccttatggcagcctcctgggtggggggcttcatccactccatagtacagattgcattgactatccagctgccattctgtgggcctgacaagctggacaacttttattgtgatgtgcctcagctgatcaaattggcctgcacagatacctttgtcttagagcttttaatggtgtctaacaatggcctggtgaccctgatgtgttttctggtgcttctgggatcgtacacagcactgctagtcatgctccgaagccactcacgggagggccgcagcaaggccctgtctacctgtgcctctcacattgctgtggtgaccttaatctttgtgccttgcatctacgtctatacaaggccttttcggacattccccatggacaaggccgtctctgtgctatacacaattgtcacccccatgctgaatcctgccatctataccctgagaaacaaggaagtgatcatggccatgaagaagctgtggaggaggaaaaaggaccctattggtcccctggagcacagacccttacattagcagaggcagtgacctgagaatctgaaagatgctacagggtattagcctgctggataggaccctc

SEQ ID NO: 4484 - DNA, 1054 bp, Homo sapiens
cctggaagagagtcatccccatcatggaccagatcaaccacactaatgtgaaggagtttttcttcctggaacttacacgttcccgagagctggagtttttcttgtttgtggtcttctttgctgtgtatgtagcaacagtcctgggaaatgcactcattgtggtcactattacctgtgagtcccgcctacacactcctatgtactttctcctgcggaacaaatcagtcctggacatcgttttttcatctatcaccgtccccaagttcctggtggatcttttatcagacaggaaaaccatctcctacaatgactgcatggcacagatctttttcttccactttgctggtggggcagatatttttttcctctctgtgatggcctatgacagataccttgcaatcgccaagcccctgcactatgtgaccatgatgaggaaagaggtgtgggtggccttggtggtggcttcttgggtgagtggtggtttgcattcaatcatccaggtaattctgatgcttccattccccttctgtggccccaacacactggatgccttctactgttatgtgctccaggtggtaaaactggcctgcactgacacctttgctttggagcttttcatgatctctaacaacggactggtgaccctgctctggttcctcctgctcctgggctcctacactgtcattctggtgatgctgagatcccactctggggaggggcggaacaaggccctctccacgtgcacgtcccacatgctggtggtgactcttcacttcgtgccttgtgtttacatctactgccggcccttcatgacgctgcccatggacacaaccatatccattaataacacggtcattacccccatgctgaaccccatcatctattccctgagaaatcaagagatgaagtcagccatgcagaggctgcagaggagacttgggccttccgagagcagaaaatgggggtgagcagtcagatggagagtggaagtctgtctgacttagttttctcaaaatgctagcctaagagtaacaggtcgctagctcttcttcca

SEQ ID NO: 4485 - DNA, 945 bp, Homo sapiens
atggatcagagaaattacaccagagtgaaagaatttaccttcctgggaattactcagtcccgagaactgagccaggtcttatttaccttcctgtttttggtgtacatgacaactctaatgggaaacttcctcatcatggttacagttacctgtgaatctcaccttcatacgcccatgtacttcctgctccgcaacctgtctattcttgacatctgcttttcctccatcacagctcctaaggtcctgatagatcttctatcagagacaaaaaccatctccttcagtggctgtgtcactcaaatgttcttcttccaccttctggggggagcagacgttttttctctctctgtgatggcgtttgaccgctatatagccatctccaagcccctgcactatatgaccatcatgagtagggggcgatgcacaggcctcatcgtggcttcctgggtggggggctttgtccactccatagcgcagatttctctattgctcccactccctttctgtggacccaatgttcttgacactttctactgcgatgtcccccaggtcctcaaacttgcctgcactgacaccttcactctggagctcctgatgatttcaaataatgggttagtcagttggtttgtattcttctttctcctcatatcttacacggtcatcttgatgatgctgaggtctcacactggggaaggcaggaggaaagccatctccacctgcacctcccacatcaccgtggtgaccctgcatttcgtgccctgcatctatgtctatgcccggcccttcactgccctccccacagacactgccatctctgtcaccttcactgtcatctcccctttgctcaatcctataatttacacgctgaggaatcaggaaatgaagttggccatgaggaaactgaagagacggctaggacaatcagaaaggattttaattcaataa

SEQ ID NO: 4486 - DNA, 942 bp, Homo sapiens
atggacagtctaaaccaaacaagagtgactgaatttgtcttcttgggactcactgataaccgggtgctggaaatgctgtttttcatggcattctcagccatttatatgctaacgctttcagggaacattctcatcatcattgccacagtctttactccaagtctccatacccccatgtatttcttcctgagcaatctgtcctttattgacatctgccactcatctgtcactgtgcctaagatgttggagggtttgcttttagaaagaaagaccatttcctttgacaactgcatcacacagctcttcttcctacatctctttgcctgtgccgagatctttctgctgatcattgtggcgtatgatcgttacgtggctatctgcactccactccactaccccaatgtgatgaacatgagagtctgtatacagcttgtctttgctctctggttggggggtactgttcactcactagggcagaccttcttgactattcgtctaccttactgtggccccaacattattgacagctacttctgtgatgtgcctcttgttatcaagctggcctgcacagatacatacctcacaggaatactgattgtgaccaatagtggaaccatctccctctcctgtttcttggccgtggtcacctcctatatggtcatcctggtttctcttcgaaaacactcagctgaagggcgccagaaagccctgtctacctgctcggcccacttcatggtggttgccctcttctttgggccatgtatcttcatctatactcggccagacaccagcttctccattgacaaggtggtgtctgtcttctacacagtggtcacccctttgctgaatcccttcatttacaccttgaggaatgaggaggtaaaaagtgccatgaagcagctcaggcagagacaagtttttttcacgaaatcatatacataa

SEQ ID NO: 4487 - DNA, 985 bp, Homo sapiens
aaactgatcttggagtctgaggcaatgaatggaatgaatcactctgtggtatcagaatttgtattcatgggactcaccaactcacgggagattcagcttctactttttgttttctctttgttgttctactttgcgagcatgatgggaaaccttgtcattgtattcactgtaaccatggatgctcatctgcactcccccatgtatttcctcctggctaacctctcaatcattgatatggcattttgctcaattacagcccctaagatgatttgtgatattttcaagaagcacaaggccatctcctttcggggatgtattactcagatcttctttagccatgctcttgggggcactgagatggtgctgctcatagccatggcctttgacagatacatggccatatgtaaacctctccactacctgaccatcatgagcccaagaatgtgtctatactttttagccacttcctctatcattggccttatccactcattggtccaattagtttttgtggtagatttacctttttgtggtcctaatatctttgacagtttttactgtgatctccctcggctcctcagacttgcctgtaccaacacccaagaactggagttcatggtcactgtcaatagtggactcatttctgtgggctcctttgtcttgctggtaatttcctacatcttcattctgttcactgtttggaaacattcttctggtggtctagccaaggccctctctaccctgtcagctcatgtcactgtggtcatcttgttctttgggccactgatgtttttctacacatggccttctcccacatcacacctggataaatatcttgctatttttgatgcatttattactccttttctgaatccagttatctacacattcaggaacaaagacatgaaagtggcaatgaggagactgtgcagtcgtcttgcgcattttacaaagattttgtaaatggcttggctgtcaagatgtg

SEQ ID NO: 4488 - DNA, 995 bp, Homo sapiens
agcccagttggctggaccaatggatggagagaatcactcagtggtatctgagtttttgtttctgggactcactcattcatgggagatccagctcctcctcctagtgttttcctctgtgctctatgtggcaagcattactggaaacatcctcattgtgttttctgtgaccactgaccctcacttacactcccccatgtactttctactggccagtctctccttcattgacttaggagcctgctctgtcacttctcccaagatgatttatgacctgttcagaaagcgcaaagtcatctcctttggaggctgcatcgctcaaatcttcttcatccacgtcgttggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcaataaagagagtatgcaaacagctagtgatttacaagaggatctcataaatgatataataagcccttctcattaaacatgatatgg

SEQ ID NO: 4489 - DNA, 918 bp, Homo sapiens
atggtgactgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacagctgagaaaatgggatgcacattctagtgtaaagttttag

SEQ ID NO: 4490 - DNA, 883 bp, Homo sapiens
tccccaggtccggtgttttcttacccacctccttccctcctttttataataccagtgaaacttggtttggagcatttctttcacataaaggtaactgcagaggctatttcctggaatgaatcaacgagtgaaacgaataactctatggtgactgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccat

SEQ ID NO: 4491 - DNA, 995 bp, Homo sapiens
agcccagttggctggaccaatggatggagagaatcactcagtggtatctgagtttttgtttctgggactcactcattcatgggagatccagctcctcctcctagtgttttcctctgtgctctatgtggcaagcattactggaaacatcttcattgtgttttctgtgaccactgaccctcacttacactcccccatgtactttctactggccagtctctccttcattgacttaggagcctgctctgtcacttctcccaagatgatttatgacctgttcagaaagcgcaaagtcatctcctttggaggctgcatcgctcaaatcttcttcatccacgtcattggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacgtcttcatcctgtttactgtttggaaacattcctcaggtggttcatccaaggccctttccactctttcagctcacagcacagtggtccttttgttctttggtccacccatgtttgtgtatacacggccacaccctaattcacagatggacaagtttctggctatttttgatgcagttctcactccttttctgaatccagttgtctatacattcaggaataaggagatgaaggcagcaataaagagagtatgcaaacagctagtgatttacaagaagatctcataaatgatacaataagcccttctcgttaaacatgatatgg

SEQ ID NO: 4492 - DNA, 995 bp, Homo sapiens; identical to SEQ ID NO: 4488

SEQ ID NO: 4493 - DNA, 995 bp, Homo sapiens; identical to SEQ ID NO: 4488

SEQ ID NO: 4494 - DNA, 1054 bp, Homo sapiens
tcctggaatgaatcaacgagtgaaacgaataactctatggtgactgaattcatttttctgggtctctctgattctcaggaactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaaacccctacactacactacaattatgtgtggcaacgcatgtgtcggcattatggctgtcgcatggggaattggctttctccattcggtgagccagttggcctttgccgtgcacttacccttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcattgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacggctgagaaaatgggatgcacattctagtgtaaagttttagatcttatataactgtgagattaatctcagataatgacacaaaatatagtgaagttggtaagttatttagtaaagctcatgaaaattgtgccctccattcc

SEQ ID NO: 4495 - DNA, 918 bp, Homo sapiens
atggtgactgaattcatttttctgggtctctctgattctcaggaactccagaccttcctatttatgttgttttttgtattctatggaggaatcgtgtttggaaaccttcttattgtcataacagtggtatctgactcccaccttcactctcccatgtacttcctgctagccaacctctcactcattgatctgtctctgtcttcagtcacagcccccaagatgattactgactttttcagccagcgcaaagtcatctctttcaagggctgccttgttcagatatttctccttcacttctttggtgggagtgagatggtgatcctcatagccatgggctttgacagatatatagcaatatgcaagcccctacactacactacaattatgtgtggcaacgcatgtgtcggcattatggctgtcacatggggaattggctttctccattcggtgagccagttggcgtttgccgtgcacttactcttctgtggtcccaatgaggtcgatagtttttattgtgaccttcctagggtaatcaaacttgcctgtacagatacctacaggctagatattatggtcattgctaacagtggtgtgctcactgtgtgttcttttgttcttctaatcatctcatacactatcatcctaatgaccatccagcatcgccctttagataagtcgtccaaagctctgtccactttgactgctcacattacagtagttcttttgttctttggaccatgtgtctttatttatgcctggccattccccatcaagtcattagataaattccttgctgtattttattctgtgatcacccctctcttgaacccaattatatacacactgaggaacaaagacatgaagacggcaataagacagctgagaaaatgggatgcacattctagtgtaaagttttag

SEQ ID NO: 4496 - DNA, 975 bp, Homo sapiens
ttgtcacagccgacagaggcaatggatgaagccaatcactctgtggtctctgagtttgtgttcctgggactctctgactcgcggaagatccagctcctcctcttcctctttttctcagtgttctatgtgtcaagcctgatgggaaatctcctcattgtgctaactgtgacctctgaccctcgtttacagtcccccatgtacttcctgctggccaacctttccatcatcaatttggtattttgttcctccacagctcccaagatgatttatgaccttttcaggaagcacaagaccatctcttttgggggctgtgtagttcagatcttctttatccatgcagttgggggaactgagatggtgctgctcatagccatggcttttgaccgatatgtggccatatgtaagcctctccactacctgaccatcatgaacccacaaaggtgcattttgtttttagtcatttcctggattataggtattattcactcagtgattcagttggcttttgttgtagacctgctgttctgtggccctaatgaattagatagtttcttttgtgatcttcctcgatttatcaaactggcttgcatagagacctacacattgggattcatggttactgccaatagtggatttatttctctggcttcttttttaattctcataatctcttacatctttattttggtgactgttcagaaaaaatcttcaggtggtatattcaaggctttctctatgctgtcagctcatgtcattgtggtggttttggtctttgggccattaatctttttctatatttttccatttcccacatcacatcttgataaattccttgccatctttgatgcagttatcactcccgttttgaatccagtcatctatacttttagaaataaagagatgatggtggcaatgagaagacgatgctctcagtttgtgaattacagtaaaatcttttaaatatattgagaatat

SEQ ID NO: 4497 - DNA, 1076 bp, Homo sapiens
tgccaatcattgtgacatttttctgatttcttttttttaggtaactgaatattggatacatggctcacacaaatgaatcgatggtgtctgagtttgtacttttgggactctctaattcctggggacttcaacttttcttttttgccatcttctctatagtctatgtgacatcagtgctaggcaatgtcttaattattgtcattatttcttttgactcccatttgaactctcctatgtacttcttgctcagtaatctttctttcattgatatctgtcagtctaactttgccacccccaagatgcttgtagacttttttattgagcgcaagactatctcctttgagggttgcatggcccagatattcgttcttcacagttttgttgggagtgagatgatgttgcttgtagctatggcatatgacagatttatagccatatgtaagcctctgcactacagtacaattatgaaccggaggctctgtgtaatttttgtgtctatttcctgggcggtgggcgttcttcattctgtgagccacttggcttttacagtggacctgccattctgtggtcccaatgaggtggatagcttcttttgtgaccttcccttggtgatagagctggcttgcatggatacatatgaaatggaaattatgaccctaacgaacagtggcctgatatcattgagctgtttcctggctttaattatttcctacaccatcattttgatcggtgtccgatgcaggtcctccagtgggtcatctaaggctctttctacattaactgcccacatcacagtggtcattcttttcttcgggccttgcatttatttctatatatggccttttagcagacttcctgtggacaaatttctttctgtgttctacactgtttgtactcccttgttgaaccccatcatctactctctgaggaatgaagatgttaaagcagccatgtggaagctgagaaaccgtcatgtgaactcctggaaaaactagggatcattacgaaggagcataatcctgaattagaatgaagaccctccagtgtatcatagtgtcatgccaaccatctttgcc

SEQ ID NO: 4498 - DNA, 917 bp, Homo sapiens
atatggaaagagcaaaccattcagtggtatcggaatttattttgttgggactttccaaatctcaaaatcttcagattttattcttcttgggattctctgtggtcttcgtggggattgtgttaggaaacctgctcatcttggtgactgtgacctttgattcgctccttcacacaccaatgtattttctgcttagcaacctctcctgcattgatatgatcctggcttcttttgctacccctaagatgattgtagatttcctccgagaacgtaagaccatctcatggtggggatgttattcccagatgttctttatgcacctcctgggtgggagtgagatgatgttgcttgtagccatggcaatagacaggtatgttgccatatgcaaacccctccattacatgaccatcatgagcccacgggtgctcactgggctactgttatcctcctatgcagttggatttgtgcactcatctagtcaaatggctttcatgttgactttgcccttctgtggtcccaatgttatagacagctttttctgtgaccttccccttgtgattaaacttgcctgcaaggacacctacatcctacagctcctggtcattgctgacagtgggctcctgtcactggtctgcttcctcctcttgcttgtctcctatggagtcataatattctcagttaggtaccgtgctgctagtcgatcctctaaggctttctccactctctcagctcacatcacagttgtgactctgttctttgctccgtgtgtctttatctacgtctggcccttcagcagatactcggtagataaaattctttctgtgttttacacaattttcacacctctcttaaatcctattatttatacattaagaaatcaagaggtaaaagcagccattaaaaaaagactctgcatataa

SEQ ID NO: 4499 - DNA, 934 bp, Homo sapiens
atggacccacagaactattccttggtgtcagaatttgtgttgcatggactctgcacttcacgacatcttcaaaattttttctttatatttttctttggggtctatgtggccattatgctgggtaaccttctcattttggtcactgtaatttctgatccctgcctgcactcctcccctatgtacttcctgctggggaacctagctttcctggacatgtggctggcctcatttgccactcccaagatgatcagggatttccttagtgatcaaaaactcatctcctttggaggatgtatggctcaaatcttcttcttgcactttactggtggggctgagatggtgctcctggtttccatggcctatgacagatatgtggccatatgcaaacccttgcattacatgactttgatgagttggcagacttgcatcaggctggtgctggcttcatgggtcgttggatttgtgcactccatcagtcaagtggctttcactgtaaatttgccttactgtggccccaatgaggtagacagcttcttctgtgacctccctctggtgatcaaacttgcctgcatggacacctatgtcttgggtataattatgatctcagacagtgggttgctttccttgagctgttttctgctcctcctgatctcctacaccgtgatcctcctcgctatcagacagcgtgctgccggtagcacatccaaagcactctccacttgctctgcacatatcatggtagtgacgctgttctttggcccttgcatttttgtttatgtgcggcctttcagtaggttctctgtggacaagctgctgtctgtgttttataccatttttactccactcctgaaccccattatctacacattgagaaatgaggagatgaaagcagctatgaagaaactgcaaaaccgacgggtgacttttcaatgaa

SEQ ID NO: 4500 - DNA, 1216 bp, Homo sapiens
tgaaaacccagacacatacatagcaataggaattggaattctgaaaagtttaagtgtaattggaaaatcaaacccatgctcacttcattaactgatctctgtttctctcctattcaggtagctgaaattaagtcccttccaaaatcgatgaatgagacaaatcattctcgggtgacagaatttgtgttgctgggactgtctagttcaagggagctccaacctttcttgtttcttacattttcactactttatctagcaattctgttgggcaactttctcatcatcctcactgtgacctcagattcccgccttcacacccccatgtactttctgcttgcaaacctgtcatttatagacgtatgtgttgcctcttttgctacccctaaaatgattgcagactttctggttgagcgcaagactatttcttttgatgcctgcctggcccagattttctttgttcatctcttcactggcagtgaaatggtgctcctagtttccatggcctatgaccgttatgttgctatatgcaaacctctccactacatgacagtcatgagccgtcgtgtatgtgttgtgctcgtcctcatttcatggtttgtgggcttcatccatactaccagccagttggcattcactgttaatctgccattttgtggtcctaataaggtagacagttttttctgtgaccttcctctagtgaccaagttagcctgcatagacacttatgttgtcagcttactaatagttgcagatagtggctttctttctctgagttcctttctcctcttggttgtctcctacactgtaatacttgttacagttaggaatcgctcctctgcaagcatggcgaaggcccgctccacattgactgctcacatcactgtggtcactttattctttggaccatgcattttcatctatgtgtggcccttcagcagttactcagttgacaaagtccttgctgtattctacaccatcttcacgcttattttaaaccctgtaatctacacgctaagaaacaaagaagtgaaggcagctatgtcaaaactgaagagtcggtatctgaagcctagtcaggtttctgtagtcataagaaatgttcttttcctagaaacaaagtaaacttatgagactgttaccactttagccctgtctccatacacttacaagtggattcactgtaatcttaaagcaaatcaacttggcctgtgggaaa

SEQ ID NO: 4501 - DNA, 1032 bp, Homo sapiens
atggctctttatttttcactcatactccatggtatgagtgatcttttctttctctctacaggtcatccaagagcgagctgtaggatggaggccatgaaactattaaatcaatctcaagtgtcagaattcattttgctgggactgaccagctcccaggatgtagagtttcttctctttgccctcttctcggttatctatgtggtcacagttttgggtaaccttcttattatagtcacagtgtttaacacccctaacctgaatactcccatgtattttctccttggtaatctctcttttgtagatatgacccttgcttcttttgccacccctaaggtgattctgaacttgttaaaaaagcagaaggtaatttcttttgctgggtgcttcactcagatatttctccttcacttactgggtggggttgaaatggtactgttggtctccatggcttttgacagatatgtggccatttgtaagcccctacactacatgaccatcatgaacaagaaggtatgtgttttgcttgtagtgacctcatggctcttgggtctccttcactcagggtttcagataccatttgctgtgaacttgcccttttgtggtcccaatgtggtagacagcattttttgtgacctccctttggttactaagcttgcctgtatagacatatattttgtacaggtagtcattgttgccaacagtggcataatctccctgagctgtttcattattttgcttatctcctacagtctgatcctcataaccattaagaaccactctcctactgggcaatctaaagcccgttccactttgactgctcacatcacagtggtgattctcttctttggcccatgcatctttatctacatttggcccttcggcaaccactctgtagataagttccttgctgtgttttataccatcatcactcctatcttgaatccaattatctatactctgagaaacaaagaaatgaagatatccatgaaaaaactctggagagcttttgtgaattctagagaagatacttag

SEQ ID NO: 4502 - DNA, 1078 bp, Homo sapiens
tttcgtgatacaggcttctgcctatgaatcaagacaatggatgtgggcaataagtctaccatgtctgaatttgttttgctggggctctctaattcctgggaactacagatgtttttctttatggtgttttcattgctttatgtggcaacaatggtgggtaacagcctcatagtcatcacagttatagtggaccctcacctacactctcctatgtatttcctgcttaccaatctttcaatcattgatatgtctcttgcttctttcgccaccccaaagatgattacagattacctaacaggtcacaaaaccatctcttttgatggctgccttacccagatattctttctccaccttttcactggaactgagatcatcttactcatggccatgtcctttgataggtatattgcaatatgcaagcccctgcactatgcttctgtcattagtccccaggtgtgtgttgctctcgtggtggcttcctggattatgggagttatgcattcaatgagtcaggtcatatttgccctcacgttaccattctgtggtccctatgaggtagacagctttttctgtgaccttcctgtggtgttccagttggcttgtgtggatacttatgttctgggcctctttatgatctcaacaagtggcataattgcgttgtcctgttttattgttttatttaattcatatgttattgtcctggttactgtgaagcatcattcttccagaggatcatctaaggccctttctacttgtacagctcatttcattgttgtcttcttgttctttgggccatgcatcttcatctacatgtggccactaagcagctttctcacagacaagattctgtctgtgttttataccatctttactcccactctgaacccaataatctatactttgaggaatcaagaagtaaagatagccatgaggaaactgaaaaataggtttctaaattttaataaggcaatgccttcatagtttttgtgacacagaacattagacacaatgctgtgttaggcttttctttctagagggttcttaccaaattgtaattgccaagaatttgtgagggctc

SEQ ID NO: 4503 - DNA, 1078 bp, Homo sapiens
cagaacaagtttgcagcttggaaccatggataagtccaattcttcagtggtgtctgaatttgtactgttgggactctgtagttctcaaaaactccagcttttctatttttgtttcttctctgtgttgtatacagtcattgtgctgggaaatcttctcattatcctcacagtgacttctgataccagcctgcactcccctatgtactttctcttgggaaacctttcctttgttgacatttgtcaggcttcttttgctacccctaaaatgattgcagattttctgagtgcacacgagaccatatctttcagtggctgcatagcccaaattttctttattcacctttttactggaggggagatggtgctacttgtttcgatggcctatgacaggtatgtagccatatgcaaacccttatactatgtggtcatcatgagccgaaggacatgcactgtcttggtaatgatctcctgggctgtgagcttggtgcacacattaagccagttatcatttactgtgaacctgcctttttgtggacctaatgtagtagacagctttttttgtgatcttcctcgagtcaccaaacttgcctgcctggactcttacatcattgaaatactaattgtggtcaatagtggaattctttccctaagcactttctctctcttggtcagctcctacatcattattcttgttacagtttggctcaagtcttcagctgcaatggcaaaggcattttctacgctggcttcccatattgcagtagtaatattattctttggaccttgcatcttcatctatgtgtggccctttaccatctctcctttggataaatttcttgccatattttacactgttttcacccccgtcctaaaccccattatttatacactaaggaatagggatatgaaggctgccgtaaggaaaattgtgaaccattacctgaggccaaggagaatttctgaaatgtcactagtagtgagaacttcctttcattaagacaaaactccttcaaattcctcaggtcaatacactgtttaatattttaatgtatttttgtggtgtatctcaattgtgggg

SEQ ID NO: 4504 - DNA, 939 bp, Homo sapiens
atggatcttaaaaatggatctctagtgaccgagtttattttactaggattttttggacgatgggaacttcaaattttcttctttgtgacattttccctgatctacggtgctactgtgatgggaaacattctcattatggtcacagtgacatgtaggtcaacccttcattctcccttgtactttctccttggaaatctctcttttttggacatgtgtctctccactgccacaacacccaagatgatcatagatttgctcactgaccacaagaccatctctgtgtggggctgcgtgacccagatgttcttcatgcacttctttgggggtgctgagatgactcttctgataatcatggcctttgacaggtatgtagccatatgtaaacccctgcactataggacaatcatgagccacaagctgctaaaggggtttgcgatactttcatggataattggttttttacactccataagccagatagttttaacaatgaacttgcctttctgtggccacaatgtcataaacaacatattttgtgatcttccccttgtgatcaagcttgcttgcattgaaacatacaccctggaattatttgtcattgctgacagcgggctgctctctttcacctgtttcatcctcttgcttgtttcttacattgtcatcctggtcagtgtaccaaaaaaatcatcacatgggctctccaaggcgctgtccacattgtctgcccacatcattgtggtcactctgttctttggaccttgtatttttatctatgtttggccattcagtagtttggcaagcaataaaactcttgccgtattttatacagttatcacacccttactgaatccgagtatttataccctgagaaataagaaaatgcaagaggccataagaaaattacggttccaatatgttagttctgcacagaatttctag

SEQ ID NO: 4505 - DNA, 1116 bp, Homo sapiens
aactctagataaatgctatgtggactaattatagtttctttaattttcatagttatattatgaaaagagtaaattgaagaaatggaaactgcaaattacaccaaggtgacagaatttgttctcactggcctatcccagactcgggaggtccaactagtcctatttgttatatttctatccttctatttgttcatcctaccaggaaatatccttatcatttgcaccatcaggctagaccctcatctgacttctcctatgtatttcctgttggctaatctggccctccttgatatttggtactcttccattacagcccctaaaatgctcatagacttctttgtggagaggaagataatttcctttggtggatgcattgcacagctcttcttcttacactttgttggggcttcggagatgttcttgctcacagtgatggcctatgaccgctatgctgctatctgccgacccctccactatgctaccatcatgaatcgacgtctctgctgtatcctggtggctctctcctggatggggggcttcattcattctataatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttcattgctctgttaatgtcctatgccttccttctggccttgctcaagaaacattcaggctcaggtgagaataccaacagggccatgtccacctgctattcccacattaccattgtggtgctaatgtttgggccatccatctacatttatgctcgcccatttgactcattttccctagataaagtggtgtctgtgtttcatactgtaatattccctttacttaatcccattatttacacattgagaaacaaggaagtaaaggcagccatgaggaaggtggtcaccaaatatattttgtgtgaagagaagtgaaagataaattatacattttatagtcctcctgaggatcattgtcctaaagcaggaagtatttgcagtaataatgctgcattcacttcctccgtt

SEQ ID NO: 4506 - DNA, 1084 bp, Homo sapiens
ttttgaaagcagtgatataactctaggtaaatgctatgtctactaattatagtttcttaattttcatagctatattatgaaaagagtaaattgaagaaatggaaactgcaaattacaccaaggtgacagaatttgttctcactggcctatcccagactccagaggtccaactagtcctatttgttatatttctatccttctatttgttcatcctaccaggaaatatccttatcatttgcaccatcagtctagaccctcatctgacctctcctatgtatttcctgttggctaatctggccttccttgatatttggtactcttccattacagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggtggctctcattgttcgacttcctttctgtgggcccaatgagttagacagttacttctgtgacatcacacaggttgtccggattgcctgtgccaacaccttcccagaggagttagtgatgatctgtagtagtggtctgatctctgtggtgtgtttgattgctctgttaatgtcctatgccttccttctggccttgttcaagaaactttcaggctcaggtgagaataccaacagggccatgtccacctgctattcccacattaccattgtggtgctaatgtttgggccatccatctacatttatgctcgcccatttgactcgttttccctagataaagtggtgtctgtgttcaatactttaatattccctttacgtaatcccattatttacacattgagaaacaaggaagtaaaggcagccatgaggaagttggtcaccaaatatattttgtgtaaagagaagtgaaagataaattatacattttatagttcccctgaggatcattgtcc

SEQ ID NO: 4507 - DNA, 924 bp, Homo sapiens
atggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttggctctgtggcttgggggttttgtccactccattatccaggtggtcctcatcctccgcttgcctttttgtggcccaaaccagctggacaacttcttctgtgatgtcccacaggtcatcaagctggcctgcaccgacacatttgtggtggagcttctgatggtcttcaacagtggcctgatgacactcctgtgctttctggggcttctggcctcctatgcagtcattctttgtcgcatacgagggtcttcttctgaggcaaaaaacaaggccatgtccacgtgcatcacccatatcattgttatattcttcatgtttggacctggcatcttcatctacacgcgccccttcagggctttcccagctgacaaggtggtttctctcttccacacagtgatttttcctttgttgaatcctgtcatttatacccttcgcaaccaggaagtgaaagcttccatgaaaaaggtgtttaataagcacatagcctga

SEQ ID NO: 4508 - DNA, 565 bp, Homo sapiens
tattaaactttaatgggtagctggtagacaattaacactctgggagggctcaaaccacataaccaaatgtgccaagataatcctgagctcactcattgtcagtcctgaagattttcctcagagaatctttcatctctttgctcctgagactatatattagaggattacagagtggtgttatcacagaatagaacaagtggatttttatctgagatctacaacttaagaagaatataagtgatgtatattctcttctactcttcatgtatggaatagaggggcttgcacagtagactcaagagaattgacatctggtgttaaaaaccaaaaatcatacaaatgactgatatgtatcattttccttattaaatatggaagaaaagggaggaggatgcagaaatggtaggctaaaagctccagagaaaaacttaacagattttatgattttgcagaagataagtccttgacctcttcattttcacattcagcaggccagggaaatggaaagcgagaacagaacagtgataagagaattcatcctccttggtctgacccagtctcaaga

SEQ ID NO: 4509 - DNA, 522 bp, Homo sapiens
aggaaaggtactagctcttctttatgcatctggtagaactcagctgtgaattcctgtgatcctgggctttttctggccagggaaatggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttg

SEQ ID NO: 4510 - DNA, 1126 bp, Homo sapiens
tgtggcataccttgtgtttagttcaagaactataatctagatgtaacacctgaaaataaactcttttattgatattctacaggcagaagaaatgaagatagcaaacaacacagtagtgacagaatttatcctccttggtctgactcagtctcaagatattcagctcttggtctttgtgctgatcttaattttctaccttatcatcctccctggaaattttctcattattttcaccataaggtcagaccctgggctcacagcccccctctatttatttctgggcaacttggccttcctggatgcatcctactccttcattgtggctcccaggatgttggtggacttcctctctgagaaaaaggtaatctcctacagaggctgcatcactcagctctttttcttgcacttccttggaggaggggagggattactccttgttgtgatggcctttgaccgctacatcgccatctgccggcctctgcactgttcaactgtcatgaaccctagagcctgctatgcaatgatgttggctctgtggcttgggggttttgtccactccattatccaggtggtcctcatcctccgcttgcctttttgtggcccaaaccagctggacaacttcttctgtgatgtccgacaggtcatcaagctggcttgcaccgacatgtttgtggtggagcttctaatggtcttcaacagtggcctgatgacactcctgtgctttctggggcttctggcttcctatgcagtcatcctctgccatgttcgtagggcagcttctgaagggaagaacaaggccatgtccacgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtacca

SEQ ID NO: 4511 - DNA, 927 bp, Homo sapiens
atggaaacacagaacctcacagtggtgacagaattcattcttcttggtctgacccagtctcaagatgctcaacttctggtctttgtgctagtcttaattttctaccttatcatcctccctggaaatttcctcatcattttcaccataaagtcagaccctgggctcacagcccccctctatttctttctgggcaacttggccttactggatgcatcctactccttcattgtggttcccaggatgttggtggacttcctctctgagaagaaggtaatctcctatagaagctgcatcactcagctctttttcttgcattttcttggagcgggagagatgttcctcctcgttgtgatggcctttgaccgctacatcgccatctgccggcctttacactattcaaccatcatgaaccctagagcctgctatgcattatcgttggttctgtggcttgggggctttatccattccattgtacaagtagcccttatcctgcacttgcctttctgtggcccaaaccagctcgataacttcttctgtgatgttccacaggtcatcaagctggcctgcaccaatacctttgtggtggagcttctgatggtctccaacagtggcctgctcagcctcctgtgcttcctgggccttctggcctcctatgcagtcatcctctgtcgtataagggagcactcctctgaaggaaagagcaaggctatttccacatgcaccacccatattatcattatatttctcatgtttggacctgctattttcatctacacttgccccttccaggctttcccagctgacaaggtagtttctcttttccatactgtcatctttcctttgatgaaccctgttatttatacgcttcgcaaccaggaggtgaaagcttccatgaggaagttgttaagtcaacatatgttttgctga

SEQ ID NO: 4512 - DNA, 939 bp, Homo sapiens
atggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctga

SEQ ID NO: 4513 - DNA, 942 bp, Homo sapiens
atgaaaaaagaacaagattctaatgtgacagaatttgttcttctgggcctatcatcttcttgggagctgcagctatttctcttcttactatttttgtttttttacattgctattgtcctgggaaacctcttgatagtggtaacagtgcaagcccatgctcacctgctccaatctcctatgtattattttttaggtcatctctctttcattgacctatgcctgagctgtgttactgtgccaaagatgttaggggatttcctacagcagggcaagagcatctctttttcaggatgcctggcccagatctacttcctccactttctaggagccagtgagatgtttttgctgacagtcatggcctatgacaggtatgttgccatctgtaaccctttgcgctaccttacagtcatgaacccccagctatgcctttggttggttcttgcctgctggtgtgggggttttatccactctatcatgcaggtcatactagtcatccagctgcctttctgtgggcccaatgaactggacaacttctactgtgatgtcccacaagtcatcaagctggcctgcatggacacctatgtggtagaggtgctggtgatagccaacagtggtctgctgtctcttgtctgcttcttggtcttactattctcttatgctatcatcctgatcaccctgagaacacacttctgccagggccagaacaaggtcttctctacctgtgcttctcacctgacagtggtcagcctgatcttcgtgccatgcgtattcatctatttgaggcctttctgcagcttctctgtggataagatattctccttgttttacacagtgattacacctatgttgaaccccctcatctacacactcagaaatactgatatgaagacagctatgaagaagctgaggataaaaccatgtggcattccattgccttgttaa

SEQ ID NO: 4514 - DNA, 930 bp, Homo sapiens
atgggtgccaagaacaatgtgactgagtttgttttatttggcctttttgagagcagagagatgcagcatacatgctttgtggtattcttcctctttcatgtgctcactgtcctggggaaccttctggtcatcatcaccatcaatgctagaaagaccctgaagtctcccatgtatttcttcctgagccagttgtcttttgctgacatatgttatccatccactaccatacccaagatgattgctgacacttttgtggagcataagatcatctccttcaatggctgcatgacccagctcttttctgcccacttctttggtggcactgagatcttcctccttacagccatggcctatgaccgctatgtggccatctgtaggcccctgcactacacagccatcatggattgccggaagtgtggcctgctagcgggggcctcctggttagctggcttcctgcattccatcctgcagaccctcctcacggttcagctgcctttttgtgggcccaatgagatagacaacttcttctgtgatgttcatcccctgctcaagttggcctgtgcagacacctacatggtaggtctcatcgtggtggccaacagcggtatgatttctttagcatccttttttatccttatcatttcctatgttatcatcttactgaacctaagaagccagtcatctgaggaccggcgtaaggctgtctccacatgtggctcacacgtaatcactgtccttttggttctcatgccccccatgttcatgtacattcgtccctccaccaccctggctgctgacaaacttatcatcctctttaacattgtgatgccacctttgctgaaccctttgatctatacactaaggaacaacgatgtgaaaaatgccatgaggaagctgtttagggtcaagaggagcttaggggagaagtga

SEQ ID NO: 4515 - DNA, 936 bp, Homo sapiens
atggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatag

SEQ ID NO: 4516 - DNA, 918 bp, Homo sapiens
atggttgctacaaacaatgtgactgaaataattttcgtgggattttcccagaattggagtgagcagagggtcatttctgtgatgtttctcctcatgtacacagctgttgtgctgggcaatggcctcattgtggtgaccatcctggccagcaaagtgctcacctcccccatgtatttctttctcagctacttatcctttgtggagatctgctactgttctgtcatggcccccaagcttatctttgactcctttatcaagaggaaagtcatttctctcaagggctgcctcacacagatgttttccctccatttctttggtggcactgaggcctttctcctgatggtgatggcctatgaccgctatgtggccatctgcaagcccttgcactacatggccatcatgaaccagcgaatgtgtggtctcctcgtgaggatagcatggggcgggggcctgctgcattctgttgggcaaaccttcctgattttccagctcccgttctgtggccccaacatcatggaccactacttctgtgatgtccacccagtgctggagctggcctgcgcagacaccttcttcattagcctgctgatcatcaccaatggcggctccatctccgtagtcagtttcttcgtgctgatggcttcctacctgatcatcctgcacttcctgagaagccacaacttggaggggcagcacaaggccctctccacctgtgcctctcatgtcacagttgtcgacctgttcttcataccttgctccttggtctatattaggccctgtgtcaccctccctgcagacaagatagttgctgtattttatacagtggtcacacctctcttaaaccctgtgatttactccttcaggaatgctgaagtgaaaaatgccatgaggagatttattgggggaaaagtaatttga

SEQ ID NO: 4517 - DNA, 1015 bp, Homo sapiens
cccaaattgctgcctcttgatgatgacctcttggctaacatacacaacatgactgaattcatttttctggtactttctcccaaccaggaggtgcagagggtttgctttgtgatatttctgttcttgtacacagcaattgtgctggggaatttcctcattgtgctcactgtcatgaccagcagaagccttggttcccccatgtacttcttcctcagctacctctccttcatggagatctgctactcctccgctacagcccccaaactcatctcagatctgctggctgaaaggaaagtcatatcttggtggggctgcatggcacagcttttcttcttgcacttctttggtggcactgagattttcctgctcactgtgatggcctatgaccactatgtggccatctgcaagcccctcagctacaccaccatcatgaactggcaggtgtgtactgtccttgtaggaatagcatgggtgggaggcttcatgcattcctttgcacaaatccttctcatcttccacctgctcttctgtggccccaatgtgatcaatcactatttctgtgacctagttccccttctcaaacttgcctgctctgacaccttcctcattggtctgctgattgttgccaatggaggcaccctgtctgtgatcagttttggggtcctcttagcatcctatatggtcatcttgctccatctgagaacctggagctctgaagggtggtgcaaagccctctccacctgtgggtcccatttcgctgtggttatcttgttctttgggccctgcgtcttcaactctctgaggccttctaccactctgcccatagacaagatggtggctgtgttctacacagtgataaccgcgatcctgaaccctgtcatctactctctgagaaatgctgaaatgaggaaggccatgaagaggctgtggattaggacattgagactaaatgagaaatagaggctgagtctttgtattgatacttgggtttagaatgactgttgagtccaaactg

SEQ ID NO: 4518 - DNA, 1051 bp, Homo sapiens
cttgtccttgtggtccacgggaagcatgtccataaccaaagcctggaacagctcatcagtgaccatgttcatcctcctgggattcacagaccatccagaactccaggccctcctctttgtgaccttcctgggcatctatcttaccaccctggcctggaacctggccctcatttttctgatcagaggtgacacccatctgcacacacccatgtacttcttcctaagcaacttatctttcattgacatctgctactcttctgctgtggctcccaatatgctcactgacttcttctgggagcagaagaccatatcatttgtgggctgtgctgctcagttttttttctttgtcggcatgggtctgtctgagtgcctcctcctgactgctatggcatacgaccgatatgcagccatctccagcccccttctctaccccactatcatgacccagggcctctgtacacgcatggtggttggggcatatgttggtggcttcctgagctccctgatccaggccagctccatatttaggcttcacttttgcggacccaacatcatcaaccacttcttctgcgacctcccaccagtcctggctctgtcttgctctgacaccttcctcagtcaagtggtgaatttcctcgtggtggtcactgtcggaggaacatcgttcctccaactccttatctcctatggttacatagtgtctgcggtcctgaagatcccttcagcagagggccgatggaaagcctgcaacacgtgtgcctcgcatctgatggtggtgactctgctgtttgggacagcccttttcgtgtacttgcgacccagctccagctacttgctaggcagggacaaggtggtgtctgttttctattcattggtgatccccatgctgaaccctctcatttacagtttgaggaacaaagagatcaaggatgccctgtggaaggtgttggaaaggaagaaagtgttttcttaggtcatgcgtagaaacttatttatccaaactgctggagaattaaacaatccaagccttcacctccacctctgcctcagg

SEQ ID NO: 4519 - DNA, 1034 bp, Homo sapiens
gactttatgcaggaagcaggcctatggctgtaggaaggaacaacacaattgtgacaaaattcattctcctgggactttcagaccatcctcaaatgaagattttccttttcatgttatttctggggctctacctcctgacgttggcctggaacttaagcctcattgccctcattaagatggactctcacctgcacatgcccatgtacttcttcctcagtaacctgtccttcctggacatctgctatgtgtcctccaccgcccctaagatgctgtctgacatcatcacagagcagaaaaccatttcctttgttggctgtgccactcagtactttgtcttctgtgggatggggctgactgaatgctttctcctggcagctatggcctatgaccggtatgctgcaatctgcaaccccttgctttacacagtcctcatatcccatacactttgtttaaagatggtggttggcgcctatgtgggtggattccttagttctttcattgaaacatactctgtctatcagcatgatttctgtgggccctatatgatcaaccactttttctgtgacctccctccagtcctggctctgtcctgctctgataccttcaccagcgaggtggtgaccttcatagtcagtgttgtcgttggaatagtgtctgtgctagtggtcctcatctcttatggttacattgttgctgctgttgtgaagatcagctcagctacaggtaggacaaaggccttcagcacttgtgcctctcacctgactgctgtgaccctcttctatggttctggattcttcatgtacatgcgacccagttccagctactccctaaacagggacaaggtggtgtccatattctatgccttggtgatccccgtggtgaatcccatcatctacagttttaggaataaggagattaaaaatgccatgaggaaagccatggaaagggaccccgggatttctcacggtggaccattcatttttatgaccttgggctaatgtttacaatgaagctgtgagctaggtgaattgtgc

SEQ ID NO: 4520 - DNA, 930 bp, Homo sapiens
atggatatatcagagggaaataagactcttgtgacagagtttgttctcacaggacttacagatcgaccatggctgcacgtcctcttctttgttgtgtttttggtggtctatctcatcaccatggtgggcaaccttggactgatagttctaatttggaacgacccccatcttcatatgcccatgtacttattccttggtggtttagccttttcagatgcttgtacttcaacctctataacccctaggatgctggtcaatttcttagacaagactgcaatgatatccctagctgagtgcatcacccagttttacttttttgcttccagtgcaactacagaatgcttcctcctggtgatgatggcctatgaccgctatgtagccatatgtaatcccttgctttatccagtgatgatgtccaacaaactcagcgctcagttgctaagtatttcatatgtaattggtttcctgcatcctctggttcatgtgagtttactattgcgactaactttctgcaggtttaacataatacattatttctactgtgaaattttacaactgttcaaaatttcatgcaatggtccatctattaacgcactaatgatatttatttttggtgcttttatacaaatacccactttaatgactatcataatctcttatactcgtgtgctctttgatattctgaaaaaaaagtctgaaaagggcagaagcaaagccttctccacatgcggcgcccatctgctttctgtctcattgtactacggaactctgatcttcatgtatgtgcgtcctgcatctggcttagctgaagaccaagacaaagtgtattctctgttttacacgattataattcccctgctaaacccatttatttacagcttgagaaataaaaaagtcatgcatgcattgagaagagttataaggaagtaa

SEQ ID NO: 4521 - DNA, 996 bp, Homo sapiens
ttctgggtccttctcttggtcatttctagacttttactagccatgacactaggaaacagcactgaagtcactgaattctatcttctgggatttggtgcccagcatgagttttggtgtatcctcttcattgtattccttctcatctatgtgacctccataatgggtaatagtggaataatcttactcatcaacacagattccagatttcaaacactcacgtacttttttctacaacatttggcttttgttgatatctgttacacttctgctatcactcccaagatgctccaaagcttcacagaagaaaagaatttgatgttatttcagggctgtgtgatacaattcttagtttatgcaacatttgcaaccagtgactgttatctcctggctatgatggcagtggatccttatgttgccatctgtaagccccttcactatactgtaatcatgtcccgaacagtctgcatccgtttggtagctggttcatacatcatgggctcaataaatgcctctgtacaaacaggttttacatgttcactgtccttctgcaagtccaatagcatcaatcactttttctgtgatgttccccctattcttgctctttcatgctccaatgttgacatcaacatcatgctacttgttgtctttgtgggatctaacttgatattcactgggttggtcgtcatcttttcctacatctacatcatggccaccatcctgaaaatgtcttctagtgcaggaaggaaaaaatccttctcaacatgtgcttcccacctgaccgcagtcaccattttctatgggacactctcttacatgtatttgcagtctcattctaataattcccaggaaaatatgaaagtggcctttatattttatggcacagttattcccatgttaaatcctttaatctatagcttgagaaataaggaagtaaaagaagctttaaaagtgatagggaaaaagttattttaaatcagccccagttgttaacattca

SEQ ID NO: 4522 - DNA, 1037 bp, Homo sapiens
gcaatccattctcttgtctcctttctgatattaggagcactgagccaatgactgggggaggaaatattacagaaatcacctatttcatcctgctgggattctcagattttcccaggatcataaaagtgctcttcactatattcctggtgatctacattacatctctggcctggaacctctccctcattgttttaataaggatggattcccacctccatacacccatgtatttcttcctcagtaacctgtccttcatagatgtctgctatatcagctccacagtccccaagatgctctccaacctcttacaggaacagcaaactatcacttttgttggttgtattattcagtactttatcttttcaacgatgggactgagtgagtcttgtctcatgacagccatggcttatgatcgttatgctgccatttgtaaccccctgctctattcatccatcatgtcacccaccctctgtgtttggatggtactgggagcctacatgactggcctcactgcttctttattccaaattggtgctttgcttcaactccacttctgtgggtctaatgtcatcagacatttcttctgtgacatgccccaactgttaatcttgtcctgtactgacactttctttgtacaggtcatgactgctatattaaccatgttctttgggatagcaagtgccctagttatcatgatatcctatggctatattggcatctccatcatgaagatcacttcagctaaaggcaggtccaaggcattcaacacctgtgcttctcatctaacagctgtttccctcttctatacatcaggaatctttgtctatttgagttccagctctggaggttcttcaagctttgacagatttgcatctgttttctacactgtggtcattcccatgttaaatcccttgatttacagtttgaggaacaaagaaattaaagatgccttaaagaggttgcaaaagagaaagtgctgctgagtttacagattctgagatttctgccagatatggcccatcagaatctccctaacc

SEQ ID NO: 4523 - DNA, 951 bp, Homo sapiens
atgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtag

SEQ ID NO: 4524 - DNA, 1006 bp, Homo sapiens
tgtgcatcttctttcttattgcagctcaaatgatgagacttatgaaagaggttcgaggcagaaatcaaacagaagtaacagaatttctcctcttaggactttccgacaatccagatctacaaggagtcctctttgcattgtttctgttgatctatatggcaaacatggtgggcaatttggggatgattgtattgattaagattgatctctgtctccacacccccatgtatttctttctcagtagcctctcttttgtagatgcctcttactcttcttccgtcactcccaagatgctggtgaacctcatggctgagaataaggccatttcttttcatggatgtgctgcccagttctacttctttggctccttcctggggactgagtgcttcctgttggccatgatggcatatgaccgctatgcagccatttggaaccccctgctctacccagttctcgtgtctgggagaatttgctttttgctaatagctacctccttcttagcaggttgtggaaatgcagccatacatacagggatgacttttaggttgtccttttgtggttctaataggatcaaccatttctactgtgacaccccgccactgctcaaactctcttgctctgatacccacttcaatggcattgtgatcatggcattctcaagttttattgtcatcagctgtgttatgattgtcctcatttcctacctgtgtatcttcattgccgtcttgaagatgccttcgttagagggcaggcacaaagccttctccacctgtgcctcttacctcatggctgtcaccatattctttggaacaatcctcttcatgtacttgcgccctacatctagctactcaatggagcaagacaaggttgtctctgtcttttatacagtaataatccctgtgctaaatcccctcatctatagtttaaaaaataaggatgtaaaaaaggccctaaagaagatcttatggaaacacatcttgtagagccatgttacccatcatttgtt

SEQ ID NO: 4525 - DNA, 1026 bp, Homo sapiens
ccaggcacacatacacttgaagcaatggataaagaaaacagctcaatggtgactgagtttatcttcatgggcatcacccaggaccctcagatggagatcatcttcttcgtggtcttcctcatagtttacctggttaatgtagtggggaatattggtatgattatcctgattacaacagacactcagcttcacacacccatgtattttttcctctgcaacctctcctttgttgacctgggctactcctcagccattgcccccaggatgctggctgacttcctaacaaatcacaaagttatctccttctccagctgtgccacccagtttgctttttttgtaggttttgtggatgctgagtgctatgtcctggcagccatggcctatggtcgttttgtggccatttgtcgacccctccactatagcaccttcatgtccaagcaggtctgcttggctctcatgctgggctcttacctggctggtctagtgagtttagtagcccacactaccctcaccttcagcctgagttactgtggttccaatatcatcaatcatttcttctgcgaaatcccaccactcttggccctctcttgctcagacacctacatcagtgagatcttgctcttcagtctgtgtggcttcattgaattcagcaccatcctcatcatcttcatctcctatacctttatccttgttgcaatcatcagaatgcgttcagctgaaggccgccttaaggctttctccacctgcgggtctcaccttactggcatcaccctcttctatggcacagtcatgtttatgtacctgaggccaacatccagctactccctggaccaagacaagtgggcctctgtgttctacacggttatcatccccatgttaaatcccttgatctacagtttgcggaacaaggatgtgaaagctgctttcaaaaagctaattggaaaaaaatctcaataataacacaaaatgaaaatctgtttctgtcataggtaaatgacagtagtagaagggcatagaaaatgcaaa

SEQ ID NO: 4526 - DNA, 975 bp, Homo sapiens
atgttggagagtaattacaccatgccaactgagttcctatttgttggattcacagattatctacctctcagagtcacactgttcttggtattccttctggtatatacattaactatggtcggaaatatactcttaataattctagttaatattaattcaagccttcaaattcccatgtattattttcttagcaacttatctttcttagacatcagctgttctacagcaatcactcctaaaatgctggcaaacttcttggcatccaggaaaagcatctctccttatgggtgtgcactacaaatgtttttcttcgcttcttttgctgatgctgagtgccttatcctggcagcaatggcttatgaccgctatgcagccatctgcaacccactgctctatactacactgatgtctaggagagtctgtgtctgcttcattgtgttggcatatttcagtggaagtacaacatcactggtccatgtgtgcctcacattcaggctgtcattttgtggctccaatatcgtcaatcattttttctgtgatatcccacctcttctggctttatcatgtacagacactcagatcaaccagcttctgctctttgctttgtgcagcttcatccagaccagcacttttgtggtaatatttatttcttacttctgcatcctcatcactgtgttgagcatcaagtcctcaggtggcagaagcaaaacattctccacttgtgcttcccacctcatagcagtcaccttattctatggagcgctcctgtttatgtacttacagcccaccactagctattccctagacactgataaggtggtggcagtgttttatactgttgtatttcccatgtttaatccaataatttatagtttcagaaacaaggatgtgaaaaatgctctcaaaaagctattagaaagaattggatattcaaatgaatggtatttaaatcgtttaagaatagtcaatatctaa

SEQ ID NO: 4527 - DNA, 1197 bp, Homo sapiens
ccaactaaccaaccaaccaaggagaaaagatcctctctatgacagagtttcatctgcaaagccaaatgccctcaataagactcatcttcagaaggctgtccttaggcagaattaaacccagtcagagccccaggtgttcaacctcatttatggtggtgccttctttctccatcgcagagcactggagaaggatgaaaggggcaaacctgagccaagggatggagtttgagctcttgggcctcaccactgacccccagctccagaggctgctcttcgtggtgttcctgggcatgtacacagccactctgctggggaacctggtcatgttcctcctgatccatgtgagtgccaccctgcacacacccatgtactccctcctgaagagcctctccttcttggatttctgctactcctccacggttgtgccccagaccctggtgaacttcttggccaagaggaaagtgatctcttattttggctgcatgactcagatgttcttctatgcgggttttgccaccagtgagtgctatctcatcgctgccatggcctatgaccgctatgccgctatttgtaaccccctgctctactcaaccatcatgtctcctgaggtctgtgcctcgctgattgtgggctcctacagtgcaggattcctcaattctcttatccacactggctgtatctttagtctgaaattctgcggtgctcatgtcgtcactcacttcttctgtgatgggccacccatcctgtccttgtcttgtgtagacacctcactgtgtgagatcctgctcttcatttttgctggtttcaaccttttgagctgcaccctcaccatcttgatctcctacttcttaattctcaacaccatcctgaaaatgagctcggcccagggcaggtttaaggcattttccacctgtgcatcccacctcactgccatctgcctcttctttggcacaacactttttatgtacctgcgccccaggtccagctactccttgacccaggaccgcacagttgctgtcatctacacagtggtgatcccagtgctgaaccccctcatgtactctttgagaaacaaggatgtgaagaaagctttaataaaggtttggggtaggaaaacaatggaatgatttctcaatgcattaccacatatctttagaaagtcaagggaacttttaccttaggtggtgtcaccctgag

SEQ ID NO: 4528 - DNA, 1054 bp, Homo sapiens
cagggcagctacataattcccaatggagaacaacacagaggtgactgaattcatccttgtggggttaactgatgacccagaactgcagatcccactcttcatagtcttccttttcatctacctcatcactctggttgggaacctggggatgattgaattgattctactggactcctgtctccacacccccatgtacttcttcctcagtaacctctccctggtggactttggttattcctcagctgtcactcccaaggtgatggtggggtttctcacaggagacaaattcatattatataatgcttgtgccacacaattcttcttctttgtagcctttatcactgcagaaagtttcctcctggcatcaatggcctatgaccgctatgcagcattgtgtaaacccctgcattacaccaccaccatgacaacaaatgtatgtgcttgcctggccataggctcctacatctgtggtttcctgaatgcatccattcatactgggaacactttcaggctctccttctgtagatccaatgtagttgaacactttttctgtgatgctcctcctctcttgactctctcatgttcagacaactacatcagtgagatggttattttttttgtggtgggattcaatgacctcttttctatcctggtaatcttgatctcctacttatttatatttatcaccatcatgaagatgcgctcacctgaaggacgccagaaggccttttctacttgtgcttcccaccttactgcagtttccatcttttatgggacaggaatctttatgtacttacgacctaactccagccatttcatgggcacagacaaaatggcatctgtgttctatgccatagtcattcccatgttgaatccactggtctacagcctgaggaacaaagaggttaagagtgcctttaaaaagactgtagggaaggcaaaggcctctataggattcatattttaattataaagaattcacaataagataattttttccacctcatattaatctttgtctaccaagcccaatatttgggcttcctcatggaca

SEQ ID NO: 4529 - DNA, 946 bp, Homo sapiens
atggagaataatacagaggtgagtgaattcatcctgcttggtctaaccaatgccccagaactacaggttcccctctttatcatgtttaccctcatctacctcatcactctgactgggaacctggggatgatcatattaatcctgctggactctcatctccacactcccatgtacttttttctcagtaacctgtctcttgcaggcattggttactcctcagctgtcactccaaaggttttaactgggttgcttatagaagacaaagccatctcctacagtgcctgtgctgctcagatgttcttttgtgcagtctttgccactgtggaaaattacctcttgtcctcaatggcctatgaccgctacgcagcagtgtgtaaccccctacattataccaccaccatgacaacacgtgtgtgtgcttgtctggctataggctgttatgtcattggttttctgaatgcttctatccaaattggagatacatttcgcctctctttctgcatgtccaatgtgattcatcactttttctgtgacaaaccagcagtcattactctgacctgctctgagaaacacattagtgagttgattcttgttcttatatcaagttttaatgtcttttttgcacttcttgttaccttgatttcctatctgttcatattgatcaccattcttaagaggcacacaggtaagggataccagaagcctttatctacctgtggttctcacctcattgccattttcttattttatataactgtcatcatcatgtacatacgaccaagttccagtcattccatggacacagacaaaattgcatctgtgttctacactatgatcatccccatgctcagtcctatagtctataccctgaggaacaaagacgtgaagaatgcattcatgaaggttgttgagaaggcaaaatattctctagattcagtcttttaat

SEQ ID NO: 4530 - DNA, 1049 bp, Homo sapiens
ttgctttatttctcattgctacaggtcatcttaagtttctcagataatactgatggagaattgtacggaagtgacaaagttcattcttctaggactaaccagtgtcccagaactacagatccccctctttatcttgttcaccttcatctacctcctcactctgtgtgggaacctggggatgatgttgctgatcctgatggactcttgtctccacacccccatgtactttttcctcagtaacctgtctctggtggactttggatactcctcagctgtcactcccaaggtcatggctgggttccttagaggagacaaggtcatctcctacaatgcatgtgctgttcagatgttcttctttgtagccttggccacggtggaaaattacttgttggcctcaatggcctatgaccgctatgcagcagtgtgcaaacccctacactacaccaccaccatgacggccagtgtaggtgcctgtctggccctaggctcatatgtctgtggcttcctaaatgcctcattccacattgggggcatattcagtctctctttctgtaaatccaatctggtacatcactttttctgtgatgttccagcagtcatggctctgtcttgctctgataaacacactagtgaggtgattctggtttttatgtcaagctttaatatcttttttgttcttctagttatctttatctcctacttgttcatattcatcaccatcttgaagatgcattcagctaagggacaccaaaaagcattgtccacctgtgcctctcacttcactgcagtctccgtcttctatgggacagtaatcttcatctacttgcagcccagctccagccactccatggacacagacaaaatggcatctgtgttctatgctatgatcatccccatgctgaaccctgtggtctacagcctgaggaacagagaagtccagaatgcattcaagaaagtgttgagaaggcaaaaatttctataagtttggaattttaacattgttgtatacacaaaaatgttgtttccctcatctcagactttcctcatgc

SEQ ID NO: 4531 - DNA, 946 bp, Homo sapiens
atggaaaataagacagaagtaacacaattcattcttctaggactaaccaatgactcagaactgcaggttcccctctttataacgttccccttcatctatattatcactctggttggaaacctgggaattattgtattgatattctgggattcctgtctccacaatcccatgtacttttttctcagtaacttgtctctagtggacttttgctactcttcagctgtcactcccatcgtcatggctggattccttatagaagacaaggtcatctcttacaatgcatgtgctgctcaaatgtatatctttgtagcttttgccactgtggaaaattacctcttggcctcaatggcctatgaccgctatgcagcagtgtgcaaacccctacattacaccacaaccatgacaacaactgtgtgtgctcgtctggccataggctcctacctctgtggtttcctgaatgcctccatccacactggggacacatttagtctctctttctgtaagtccaatgaagtccatcactttttctgtgatattccagcagtcatggttctctcttgctctgatagacatattagcgagcttgttcttatttatgttgtgagcttcaatatctttatagctctcctggttatcttgatatcctacacattcatttttatcaccatcctaaagatgcactcagcttcagtataccagaagcctttgtccacctgtgcctctcatttcattgcagtcggcatcttctatgggactattatcttcatgtacttacaacccagctccagtcactccatggacacagacaaaatggcacctgtgttctatacaatggtcatccccatgctgaaccctctggtctatagtctgaggaacaaggaagtgaagagtgcattcaagaaagttgttgagaaggcaaaattgtctgtaggatggtcagtttaac

SEQ ID NO: 4532 - DNA, 1088 bp, Homo sapiens
tggccttgccattgctcttatctccctcctgctttgcctcttctcagtctctgtccagtaggatgaactcagagaacctcacccgggccgcggttgcccctgctgaattcgtcctcctgggcatcacaaatcgctgggacctgcgtgtggccctcttcctgacctgcctgcctgtctacctggtgagcctgctgggaaacatgggcatggcgctgctgatccgcatggatgcccggctccacacacctatgtacttcttcctggccaacctctccctgctggatgcctgctattcctccgccatcggccccaagatgctagtggacctgctgctgccccgagccaccatcccttacacagcctgtgccctccagatgtttgtctttgcaggtctggctgatactgagtgttgcttgctggcagccatggcctatgaccgctacgtggccatcagaaacccacttctctatacaacagctatgtcgcagcgtctatgcctggccttgctgggagcatcaggcctgggtggggcagtgagtgcctttgttcacacaaccctcaccttccgcctgagcttctgccgctcccggaagatcaatagcttcttctgcgatatccctccactgctggccatctcgtgcagtgacaccagtctcaatgaactccttctcttcgccatctgtggcttcatccagacagccacggtgttagctatcacggtgtcttatggcttcatcgctggggctgtgatccacatgcgctcggtcgagggcagtcggcgagcagcctccaccggtggttcccacctcacagccgtggccatgatgtacgggacactcattttcatgtacctgcgccccagctccagctatgccctggacactgacaagatggcctctgtgttctataccctggtcatcccgtctctcaacccactcatctacagcctccgcaataaggaggtcaaggaggccctcaggcagacctggagccgattccactgtccagggcaggggtcccagtgattggtccagggaggctgggtaggtctgactatgaggggatgaggaaggtcggggcctctttct

SEQ ID NO: 4533 - DNA, 945 bp, Homo sapiens
atgatggcatctgaaagaaatcaaagcagcacacccacttttattctcttgggtttttcagaatacccagaaatccaggttccactctttctggttttcttgttcgtctacacagtcactgtagtggggaacttgggcatgataataatcatcagactcaattcaaaactccatacaatcatgtgctttttccttagtcacttgtccttgacagacttctgtttttccactgtagttacacctaaactgttggagaacttggttgtggaatacagaaccatctctttctctggttgcatcatgcaattttgttttgcttgcatttttggagtgacagaaactttcatgttagcagcgatggcttatgaccgttttgtggcagtttgtaaacccttgctgtataccactattatgtctcagaagctctgtgctcttctggtggctgggtcctatacatgggggatagtgtgctccctgatactcacatattttcttcttgacttatcgttttgtgaatctaccttcataaataattttatctgtgaccactctgtaattgtttctgcctcctactcagacccctatatcagccagaggctatgctttattattgccatattcaatgaggtgagcagcctaattatcattctgacatcatatatgcttattttcactaccattatgaagatgcgatctgcaagtgggcgccagaaaactttctccacctgtgcctcccacctgacagccatcactatcttccatggaactatccttttcctttactgtgttcctaatcctaaaacttctagcctcatagttacagtggcttctgtgttttacacagtggcgattccaatgctgaacccattgatctacagccttaggaacaaagatatcaataacatgtttgaaaaattagttgtcaccaaattgatttaccactga

SEQ ID NO: 4534 - DNA, 945 bp, Homo sapiens
atgatgatggttttaaggaatctgagcatggagcccacctttgcccttttaggtttcacagattacccaaagcttcagattcctctcttccttgtgtttctgctcatgtatgttatcacagtggtaggaaaccttgggatgatcataataatcaagattaaccccaaatttcacactcctatgtactttttccttagtcacctctcttttgttgatttttgttactcttccattgtcactcccaagctgcttgagaacttggtaatggcagataaaagcatcttctactttagctgcatgatgcagtacttcctgtcctgcactgctgtggtgacagagtctttcttgctggcagtgatggcctatgaccgctttgtggccatctgcaatcctctgctttatacagtggccatgtcacagaggctctgtgccctgctggtggctgggtcatatctctggggcatgtttggccccttggtactcctttgttatgctctccggttaaacttctctggacctaatgtaatcaaccacttcttttgtgagtatactgctctcatctctgtgtctggctctgatatactcatcccccacctgctgcttttcagcttcgccaccttcaatgagatgtgtacactactgatcatcctcacttcctatgttttcatttttgtgactgtactaaaaatccgttctgttagtgggcgccacaaagccttctccacctgggcctcccacctgacttctatcaccatcttccatgggaccatccttttcctttactgtgtacccaactccaaaaactctcggcaaacagtcaaagtggcctctgtattttacacagttgtcaaccccatgctgaaccctctgatctacagcctaaggaataaagacgtgaaggatgctttctggaagttaatacatacacaagttccatttcactga

SEQ ID NO: 4535 - DNA, 987 bp, Homo sapiens
atgtttctgacagagagaaatacgacatctgaggccacattcactctcttgggcttctcagattacctggaactgcaaattcccctcttctttgtatttctggcagtctacggcttcagtgtggtagggaatcttgggatgatagtgatcatcaaaattaacccaaaattgcatacccccatgtattttttcctcaaccacctctcctttgtggatttctgctattcctccatcattgctcccatgatgctggtgaacctggttgtagaagatagaaccatttcattctcaggatgtttggtgcaattctttttcttttgcacctttgtagtgactgaattaattctatttgcggtgatggcctatgaccactttgtggccatttgcaatcctctgctctacacagttgccatctcccagaaactctgtgccatgctggtggttgtattgtatgcatggggagtcgcatgttccctgacactcgcgtgctctgctttaaagttatcttttcatggtttcaacacaatcaatcatttcttctgtgagttatcctccctgatatcactctcttaccctgactcttatctcagccagttgcttcttttcactgttgccacttttaatgagataagcacactactcatcattctgacatcttatgcattcatcattgtcaccaccttgaagatgccttcagccagtgggcaccgcaaagtcttctccacctgtgcctcccacctgactgccatcaccatcttccatggcaccatcctcttcctctactgtgtacccaactccaaaaactccaggcacacagtcaaagtggcctctgtgttttacaccgtggtgatccccttgttgaatcccctgatctacagtctgagaaataaagatgttaaggatgcaatccgaaaaataatcaatacaaaatattttcatattaaacataggcattggtatccatttaattttgttattgaacaataa

SEQ ID NO: 4536 - DNA, 988 bp, Homo sapiens
gattcgaagaaacagaagcgatgctgctgactgatagaaatacaagtgggaccacgttcaccctcttgggcttctcagattacccagaactgcaagtcccactcttcctggtttttctggccatctacaatgtcactgtgctagggaatattgggttgattgtgatcatcaaaatcaaccccaaactgcatacccccatgtactttttcctcagccaactctcctttgtggatttctgctattcctccatcattgctcccaagatgttggtgaaccttgttgtcaaagacagaaccatttcatttttaggatgcgtagtacaattctttttcttctgtacctttgtggtcactgaatcctttttattagctgtgatggcctatgaccgcttcgtggccatttgcaaccctctgctctacacagttaacatgtcccagaaactctgcgtgctgctggttgtgggatcctatgcctggggagtctcatgttccttggaactgacgtgctctgctttaaagttatgttttcatggtttcaacacaatcaatcacttcttctgtgagttctcctcactactctccctttcttgctctgatacttacatcaaccagtggctgctattctttcttgccacctttaatgaaatcagcacactactcatcgttctcacatcttatgcgttcattgttgtaaccatcctcaagatgcgttcagtcagtgggcgccgcaaagccttctccacctgtgcctcccacctgactgccatcaccatcttccatggcaccatcctcttcctttactgtgtgcccaactccaaaaactccaggcacacagtcaaagtggcctctgtgttttacaccgtggtgatccccatgttgaatcccctgatctacagtctgagaaataaagatgtcaaggatacagtcaccgagatactggacaccaaagtcttctcttactgagcctgttactttcatggagtttgtca

SEQ ID NO: 4537 - DNA, 945 bp, Homo sapiens
atgaccagaaaaaattatacctcactgactgagttcgtcctattgggattagcagacacgctggagctacagattatcctctttttgttttttcttgtgatttatacacttacagtactgggaaatctcgggatgatcctcttaatcaggatcgattcccagcttcacacacccatgtatttcttcctggctaacctgtcctttgtggacgtttgtaactcaactaccatcaccccaaagatgctggcagatttattatcagagaagaaaaccatctcttttgctggctgcttcctacagatgtacttctttatctccctggcgacaaccgaatgcatcctctttgggttaatggcctatgacaggtatgcggccatatgtcgcccgctgctttactccttgatcatgtccaggaccgtctacctaaaaatggcagccggggcttttgctgcagggttgctgaacttcatggtcaacacaagccatgtcagcagcttgtcattctgtgactccaatgtcatccatcacttcttctgtgacagtcccccacttttcaagctctcttgttctgacacaatcctgaaagaaagcataagttctattttggctggtgtgaatattgtggggactctgcttgtcatcctctcctcctactcctacgttctcttctccattttttctatgcattcgggggaggggaggcacagagctttctccacgtgtgcctctcacctgacagccataattctgttctatgccacctgcatctatacttacctgagacctagttccagctactccctgaatcaggacaaagtggcttctgtgttctacacagtggtgattcccatgttgaatcctctgatctacagcctcaggagtaaggaagtaaagaaggctttagcgaatgtaattagcaggaaaaggacctcttcctttctgtga

SEQ ID NO: 4538 - DNA, 1080 bp, Homo sapiens
tcattgcagatgttccctttcatttgttgcattttattttagaggacatgcagtgaggacatggaagaggaaaatgcaacattgctgacagagtttgttctcacaggatttttatatcaaccacagtggaaaatacccctgttcctggcattcttggtaatatatctcatcaccatcatggggaatcttggtctgattgctgtcatctggaaagaccctcatcttcatatcccaatgtacttactccttgggaatttagcttttgtggatgctttgttatcatcctcagtgactctgaagatgctgatcaacttcttagctaagagtaagatgatatctctctctgaatgcaagatacagttgttttcgtttgcaatcagtgtaaccacggaatgttttctcttggcaacaatggcatatgatcgctatgtagccatatgcaaacccttactttatccagccattatgaccaatggactgtgcatccggctattaatcttgtcatatgtaggtggtcttcttcatgctttaatccatgaaggatttttattcagactaaccttctgtaactccaacataatacaacacttttactgtgacattatcccattgttaaagatttcttatactgattcctctattaactttctaatggtttttatttttgcaggttcaattcaagtttttaccatagggactgttcttatatcttacatatttgtcctctatacaatcttgaaaaagaagtctgtcaaaggtatgagaaaagccttctccacctgtggagctcatctcttatctgtatctttatactatgggcccctcgccttcatgtatatgggctctgcatccccacaggctgatgaccaagatatgatggagtctctattttacactgtcatagttcctttattaaatcccatgatctacagcctgagaaacaagcaagtaatagcttcattcacaaaaatgttcaaaagaaatgatgtttagatcattactaatatctcttttctatttactaaaatgtcacaaaattgtgcaaattagaggtacctatgtttttgccagcattaaaag

SEQ ID NO: 4539 - DNA, 945 bp, Homo sapiens
atgtcgaatgaggacatggaacaggataatacaacattgctgacagagtttgttctcacaggacttacatatcagccagagtggaaaatgcccctgttcttggtgttcttggtgatctatctcatcactattgtgtggaaccttggtctgattgctcttatctggaatgacccacaacttcacatccccatgtacttttttcttgggagtttagcctttgttgatgcttggatatcttccacagtaactcccaaaatgttggttaatttcttggccaaaaacaggatgatatctctgtctgaatgcatgattcaatttttttcctttgcatttggtggaactacagaatgttttctcttggcaacaatggcatatgatcgctatgtagccatatgcaaacctttactatatccagtgattatgaacaattcactatgcatacggctgttagccttctcatttttaggtggcttcctccatgccttaattcatgaagtccttatattcagattaaccttctgcaattctaacataatacatcatttttactgtgatattataccactgtttatgatttcctgtactgacccttctattaattttctaatggtttttattttgtctggctcaattcaggtattcaccattgtgacagttcttaattcttacacatttgctcttttcacaatcctaaaaaagaagtctgttagaggcgtaaggaaagccttttccacctgtggagcccatctcttatctgtctctttatattatggcccacttatcttcatgtatttgcgccctgcatctccacaagcagatgaccaagatatgatagactctgtcttttatacaatcataattcctttgctaaatcccattatctacagtctgagaaataaacaagtaatagattcattcacaaaaatggtaaaaagaaatgtttag

SEQ ID NO: 4540 - DNA, 945 bp, Homo sapiens
atggaatttacagatagaaactacacgttggtcactgagtttattctattaggttttccaactcgccctgaactgcagattgtcctgttcctcatgtttctgacattgtatgctataattctgatagggaacattggattgatgctgttgatcaggattgatcctcaccttcaaacccccatgtattttttccttagcaacctatcatttgtagacctttgctatttctcagacattgttcccaaaatgctggtcaatttcctctcggagaacaaatctatttcctattatgggtgtgccctgcagttttattttttctgtacttttgcagatacagaatccttcatcctggccgccatggcctatgatcgctatgtcgccatctgtaaccctttattgtacacagttgtgatgtctaggggcatctgtatgcggttgattgtcttgtcataccttggaggcaacatgagttccctggttcacacatcctttgcctttattctgaaatattgtgacaaaaatgttattaatcattttttctgtgacctccctcccctgcttaaactatcctgcactgacacaacaattaatgagtggctcctctccacatacggcagctcagtggaaatcatttgttttatcatcatcatcatctcctactttttcattcttctctcagtcttaaagatccgctctttcagtgggaggaagaagaccttttctacatgcgcctctcacctgacttcagtgacgatctaccaagggactctcctctttatttactcacggcccagctacctgtattctccaaacactgataaaattatctcagtgttctacaccattttcattccagtgctgaatccgttgatttatagtttgagaaataaagatgtaaaggatgcagctgagaaagttctaagatcaaaggtagattcttcatga

SEQ ID NO: 4541 - DNA, 939 bp, Homo sapiens
atggctgatgataattttacagttgtcactgagtttattcttttgggattgacagatcatgctgaactaaaagctgtgctttttgtggtgttcctggtgatttacgccattaccttgttgaggaatctgggcatgatcctcttaatccaaatcacctccaaactccacacacccatgtactttttactcagctgtctttcatttgtggatgcctgctattcatctgcaattgcacccaaaatgctggtgaacctcctggttgtgaaggcaacaatttctttctctgcttgcatggtacagcatttgtgtttcggagtgttcatcaccacagaaggcttcttactgtcagtgatggcctatgaccgctatgtggccattgtgagtcccttgctttacactgtagccatgtctgatagaaagtgtgtggagcttgtcacaggatcatggataggtggaatagttaacacattaatccacacaatcagcttgaggagactgtccttttgtaggctaaatgctgtcagccacttcttctgtgacattccttcactgctaaagctgtcatgttctgacacctccatgaatgagttgttgctgttaaccttctccggagtcattgccatggccaccttcttgactgtgatcatttcctacatcttcattgcttttgctagcctaaggatccactcagcatcaggcagacagcaagccttctccacctgtgcctctcacctgactgctgtgaccatattctatggtaccttaatctttagctacattcagccaagctcccagtattttgtggaacaagagaaagtggtttctatgttctatacgctagggattcccatgttaaacctgttgatacacagtttgagaaacaaggacgtaaaggaggcagtgaaaagggccatagaaatgaaacatttcctctgttaa

SEQ ID NO: 4542 - DNA, 1097 bp, Homo sapiens
tgctctccttcctttaagccaaagagacctaaataactgtggcatattataaattagtgccttctttctccacaattttttttcagacaagtcaggaatggctgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacaccgtcggcttcacacaccaatgtacatctttctgggaaatctggctcttgtggattcttgctgtgcctgtgctattacccccaaaatgttagagaacttcttttctgagaacaaaaggatttccctctatgaatgtgcagtacagttttattttctttgcactgtggaaactgcagactgctttcttctggcagcaatggcctatgaccgctatgtggccatatgcaacccactgcagtaccacatcatgatgtccaagaaactctgcattcagatgaccacaggggccttcatagctggaaacctgcattccatgattcatgtagggcttgtatttaggttagttttctgtggatcgaatcacatcaaccacttttactgtgatattcttcccttgtatagactctcttgtgttgatccttatatcaatgaactggttctattcatcttctcaggttcagttcaagtctttaccataggtagtgtcttaatatcttatctctatattcttcttactattttcaaaatgaaatccaaagagggaagggccaaagctttttctacctgtgcatcccactttttgtcagtttcattattctatggatctcttttcttcatgtacgttagaccaaatttgcttgaagaaggggataaagatataccagctgcaattttatttacaatagtagttcccttactaaatcctttcatttatagcctgagaaatagggaagtaataagtgtcttaagaaaaattctgatgaagaaataatctcaagaaagatggaaacaagtgacatctactatagcttaatgatttaaatgcagcaaaaacttccatgtga

SEQ ID NO: 4543 - DNA, 1049 bp, Homo sapiens
caaagagacgtcaataattgtggcatattattaattagtgccttattcctctacaatttttttcagagaggtcaggaatggttgaagaaaatcataccatgaaaaatgagtttatcctcacaggatttacagatcaccctgagctgaagactctgctgtttgtggtgttctttgccatctatctgatcaccgtggtggggaatattagtttggtggcactgatatttacacactgtcggcttcacacaccaatgtacatctttctgggaaatctggctcttgtggattcttgctgtgcctgtgctattacccccaaaatgttagagaacttcttttctgagggcaaaaggatttccctctatgaatgtgcagtacagttttattttctttgcactgtggaaactgcagactgctttcttctggcagcagtggcctatgaccgctatgtggccatctgcaacccactgcagtaccacatcatgatgtccaagaaactctgcattcagatgaccacaggcgccttcatagctggaaatctgcattccatgattcatgtagggcttgtatttaggttagttttctgtggattgaatcacatcaaccacttttactgtgatactcttcccttgtatagactctcctgtgttgaccctttcatcaatgaactggttctattcatcttctcaggttcagttcaagtctttaccataggtagtgtcttaatatcttatctctatattcttcttactattttcagaatgaaatccaaggagggaagggccaaagccttttctacttgtgcatcccacttttcatcagtttcattattctatggatctatttttttcctatacattagaccaaatttgcttgaagaaggaggtaatgatataccagctgctattttatttacaatagtagttcccttactaaatcctttcatttatagtctgagaaacaaggaagtaataagtgtcttaagaaaaattctgctgaaaataaaatctcaaggaagtgtgaacaaatgacatctatcctagcttaatggt

SEQ ID NO: 4544 - DNA, 966 bp, Homo sapiens
atggctagggaaaatcactccttagcagctgaattcatcctcataggatttacaaattatccagagctgaagacgcttctgtttgtggtgttctctgccatctatctggtcaccatggtggggaatcttggtctggtggcattaatttatgtagagcgtcgtcttctcacaccaatgtacatctttctgggcaacctggctctgatggattcctgctgttcctgtgctgttacccccaagatgttagagaatttcttttctgaggatagaattatttccctgtatgaatgtatggcacaattttattttctctgtcttgctgaaaccacagactgctttcttctggcgacaatggcctatgaccgctatgtggccatatgccacccactgcagtaccacaccatgatgtccaagacgctctgcattcggatgaccacaggggccttcaaagctggaaacctgcattccatgattcatgtagggcttttattaaggttaactttctgcaggtctaataaaattcaccactttttctgtgatattcttccactgtatagactctcctgtacagatccttctattaatgaactaatgatatatatcttttcaataccaattcaaatctttaccattgctactgtcttgatctcttatctctgcatccttttgactgttttcaaaatgaaatccaaggagggaagaggtaaagcattttctacctgtgcatcccactttctctctgtctcaatattttacatttgtcttctcatgtatattggaccatctgaagaaggagataaagatacaccagtggcaatattttatgcaatagtaatcccattactaaacccttttatttatagtctgagaaataaggaggtcataaatgttcttaaaaaaattatgaggaattataacattcttaaacaaacttgctctatagcaaatttatttttaatttattaa

SEQ ID NO: 4545 - DNA, 1099 bp, Homo sapiens
acaggatacagccaaaactaaaatttagactatataatggagaataatttttaagtttcttttcctccaatctcatataaattggagacatgggcaaggaaaactgcaccactgtggctgagttcattctccttggactatcagatgtccctgagttgagagtctgcctcttcctgctgttccttctcatctatggagtcacgttgttagccaacctgggcatgattgcactgattcaggtcagctctcggctccacacccccatgtactttttcctcagccacttgtcctctgtagatttctgctactcctcaataattgtgccaaaaatgttggctaatatctttaacaaggacaaagccatctccttcctagggtgcatggtgcaattctacttgttttgcacttgtgtggtcactgaggtcttcctgctggccgtgatggcctatgaccgctttgtggccatctgtaaccctttgctatacacagtcaccatgtcttggaaggtgcgtgtggagctggcttcttgctgctacttctgtgggacggtgtgttctctgattcatttgtgcttagctcttaggatccccttctatagatctaatgtgattaaccactttttctgtgatctacctcctgtcttaagtcttgcttgctctgatatcactgtgaatgagacactgctgttcctggtggccactttgaatgagagtgttaccatcatgatcatcctcacctcctacctgctaattctcaccaccatcctgaagatgggctctgcagagggcaggcacaaagccttctccacctgtgcttcccacctcacagctatcactgtcttccatggaacagtcctttccatttattgcaggcccagttcaggcaatagtggagatgctgacaaagtggccaccgtgttctacacagtcgtgattcctatgctgaactctgtgatctacagcctgagaaataaagatgtgaaagaagctctcagaaaagtgatgggctccaaaattcactcctagggaagattttattagcacaattcaggattcccaagtagtggcaggcgggggttcacgggagaggcacagtgttg

SEQ ID NO: 4546 - DNA, 936 bp, Homo sapiens
atgggcaaggaaaactgcaccactgtggctgagttcattctccttggactatcagatgtccctgagttgagagtctgcctcttcctgctgttccttctcatctatggagtcacgttgttagccaatctgggcatgactgcactgattcaggtcagctctcggctccacacccccgtgtactttttcctcagccacttgtcctttgtagatttctgctactcctcaataattgtgccaaagatgttggctaatatctttaacaaggacaaagccatctccttcctagggtgcatggtgcaattctacttgttttgcacatgtggagtcactgaggtcttcctgctggccgtgatggcctatgaccgctttgtggccatctgtaaccccctgctgtacatggtgaccatgtctcagaagctgcgtgtggagctgacctcttgctgctacttctgtgggacggtgtgttctctgattcactcgtccttagctcttaggatcctcttctatagatctaatgtgattaaccacttcttctgtgatctaccccctctcctaagtcttgcttgctctgatgtcactgtgaatgagacactgctgttcctggtggccactttgaatgagagtgttaccatcatgatcatcctcacctcctacctgctaattctcaccactatcctgaagatacactctgcagagagcaggcacaaagctttctccacctgtgcctcccacctcacagccatcactgtctcccatggaacaatcctttacatttattgcaggccgagttcaggcaacagtggagatgttgacaaagtggccaccgtgttctacacagttgtgattcccatgctgaaccccctgatctacagcctgagaaataaggatgtgaacaaagctctcagaaaagtgatgggctccaaaattcactcctag

SEQ ID NO: 4547 - DNA, 948 bp, Homo sapiens
atgttctccccaaaccacaccatagtgacagaattcattctcttgggactgacagacgacccagtgctagagaagatcctgtttggggtattccttgcgatctacctaatcacactggcaggcaacctgtgcatgatcctgctgatcaggaccaattcccacctgcaaacacccatgtatttcttccttggccacctctcctttgtagacatttgctattcttccaatgttactccaaatatgctgcacaatttcctctcagaacagaagaccatctcctacgctggatgcttcacacagtgtcttctcttcatcgccctggtgatcactgagttttacatccttgcttcaatggcattggatcgctatgtagccatttgcagccctttgcattacagttccaggatgtccaagaacatctgtgtctgtctggtcactatcccttacatgtatgggtttcttagtgggttctctcagtcactgctaacctttcacttatccttctgtggctcccttgaaatcaatcatttctactgcgctgatcctcctcttatcatgctggcctgctctgacacccgtgtcaaaaagatggcaatgtttgtagttgcaggctttaatctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataactgcagtcttttatacttttttgagcccaatgctgaacccattgatctatagcctacggaacacagatgtaatccttgccatgcaacaaatgattaggggaaaatcctttcataaaattgcagtttag

SEQ ID NO: 4548 - DNA, 1052 bp, Homo sapiens
tgccaaatctggatcagagagaatcctcacattctttgtcactttcagttttcaagaaataagaagatgttgtccccaaaccacaccatagtgacagaattcattctcttaggactgacagacgacccagtgctagagaagatcctgtttggggtgttcctggcgatctacctaatcacactggcaggcaacctgtgcatgatcctgctgatcaggaccaattcccaactgcaaacacccatgtatttcttccttggtcacctctcctttgtagacatttgctattcttccaatgttactccaaatatgctgcacaatttcctctcagaacagaagaccatctcctacgctggatgcttcacacagtgtcttctcttcatcgccctagtgatcactgagttttacttccttgcttcaatggcattggatcgctatgtagccatttgcagccctttacattacagttccaggatgtccaagaacatttgcatctctctggtcactgtgccttacatgtatggcttccttaatgggctctctcagacactgctgacctttcacttatccttctgtggctcccttgaaatcaatcatttctactgcgctgatcctcctcttatcatgctggcctgctctgacacccgtgtcaaaaagatggcaatgtttgtagttgcaggctttactctctcaagctctctcttcatcattcttctgtcctatcttttcatttttgcagcgatcttcaggatccgttctgctgaaggcaggcacaaagccttttctacgtgtgcttcccacctgacaatagtcactttgttttatggaaccctcttctgcatgtacgtaaggcctccatcagagaagtctgtagaggagtccaaaataattgcagtcttttatacttttttgagcccaatgctgaacccattgatctatagcctacggaacagagatgtaatccttgccatacaacaaatgattaggggaaaatccttttgtaaaattgcagtttaggcctgtgtttatttgtaatccctaagtgcctgtggggt

SEQ ID NO: 4549 - DNA, 1012 bp, Homo sapiens
gcttgaagagcaaactgtcaggaaatgtccaacacaaatggcagtgcaatcacagaattcattttacttgggctcacagattgcccggaactccagtctctgctttttgtgctgtttctggttgtttacctcgtcaccctgctaggcaacctgggcatgataatgttaatgagactggactctcgccttcacacgcccatgtacttcttcctcactaacttagcctttgtggatttgtgctatacatcaaatgcaaccccgcagatgtcgactaatatcgtatctgagaagaccatttcctttgctggttgctttacacagtgctacattttcattgcccttctactcactgagttttacatgctggcagcaatggcctatgaccgctatgtggccatatatgaccctctgcgctacagtgtgaaaacgtccaggagagtttgcatctgcttggccacatttccctatgtctatggcttctcagatggactcttccaggccatcctgaccttccgcctgaccttctgtagatccagtgtcatcaaccacttctactgtgctgacccgccgctcattaagctttcttgttctgatacttatgtcaaagagcatgccatgttcatatctgctggcttcaacctctccagctccctcaccatcgtcttggtgtcctatgccttcattcttgctgccatcctccggatcaaatcagcagagggaaggcacaaggcattctccacctgtggttcccatatgatggctgtcaccctgttttatgggactctcttttgcatgtatataagaccaccaacagataagactgttgaggaatctaaaataatagctgtcttttacacctttgtgagtccggtacttaatccattgatctacagtctgaggaataaagatgtgaagcaggccttgaagaatgtcctgagatgaaatattgtcatgaccatggtgatgcctttgtttcctaataaacattaaatcgaaatctttggctcacatg

SEQ ID NO: 4550 - DNA, 1051 bp, Homo sapiens
tcaaaaagttttgtaactgatattgacttagaattcagaaaatgctcaatttcaccgatgtgacagagttcattcttttggggctaacgagccgtcgagaatggcaagttctcttcttcatcatctttcttgtggtctacatcatcaccatggtgggcaatatcggcatgatggtgttaatcaaggtcagtcctcagcttaacaaccccatgtactttttcctcagtcacttgtcatttgttgatgtgtggttttcttccaatgtcacccctaaaatgttggaaaacctgttatcagataaaaaaacaattacttatgctggttgtttagtacagtgtttcttcttcattgctcttgtccatgtggaaatttttattcttgctgcgatggcctttgatagatacatggcaattgggaatcctctgctttatggcagtaaaatgtcaagggttgtctgtattcgactgattactttcccttacatttatggttttctgacgagtctggcagcaacattatggacttacggcttgtacttctgtggaaaaattgagatcaaccatttctactgtgcagatccacctctcatcaaaatggcctgtgctgggacctttgtaaaagaatatacaatgatcatacttgccggcattaacttcacatattccctgactgtaattatcatctcttacttattcatcctcattgccattctgcgaatgcgctcagcagaaggaaggcagaaggccttttccacatgtgggtcccatctgacagctgtcattatattctatggtactctgatcttcatgtatctcagacgtcccacagaggagtctgtggagcaggggaagatggtggctgtgttctataccacagtgatccccatgttgaatcccatgatctacagtctgaggaacaaggatgtgaaaaaggccatgatgaaagtgatcagcagatcatgttaaacaaaataaaatcaaatttgatttaattttatcttctattatttgtttggaaaaagtttattacccagtacctaggaacattaaga

SEQ ID NO: 4551 - DNA, 1047 bp, Homo sapiens
ttcctttcttccaccgaaggaaattatgagaagaaactgcacgttggtgactgagttcattctcctgggactgaccagtcgccgggaattacaaattctcctcttcacgctgtttctggccatttacatggtcacggtggcagggaaccttggcatgattgtcctcatccaggccaacgcctggctccacatgcccatgtactttttcctgagccacttatccttcgtggatctgtgcttctcttccaatgtgactccaaagatgctggagattttcctttcagagaagaaaagcatttcctatcctgcctgtcttgtgcagtgttacctttttatcgccttggtccatgttgagatctacatcctggctgtgatggcctttgaccggtacatggccatctgcaaccctctgctttatggcagcagaatgtccaagagtgtgtgctccttcctcatcacggtgccttatgtgtatggagcgctcactggcctgatggagaccatgtggacctacaacctagccttctgtggccccaatgaaattaatcacttctactgtgcggacccaccactgattaagctggcttgttctgacacctacaacaaggagttgtcaatgtttattgtggctggctggaacctttctttttctctcttcatcatatgtatttcctacctttacattttccctgctattttaaagattcgctctacagagggcaggcaaaaagctttttctacctgtggctcccatctgacagctgtcactatattctatgcaacccttttcttcatgtatctcagacccccctcaaaggaatctgttgaacagggtaaaatggtagctgtattttataccacagtaatccctatgctgaaccttataatttatagccttagaaataaaaatgtaaaagaagcattaatcaaagagctgtcaatgaagatatacttttcttaaaaatcagtattcttttggtttctaaagcccttcctagacttttttctttagctgagaaatatagtgcatcaatggagaacattgca

SEQ ID NO: 4552 - DNA, 933 bp, Homo sapiens
atgcctaatttcacggatgtgacagaatttactctcctggggctgacctgtcgtcaggagctacaggttctcttttttgtggtgttcctagcggtttacatgatcactctgttgggaaatattggtatgatcattttgattagcatcagtcctcagcttcagagtcccatgtactttttcctgagtcatctgtcttttgcggacgtgtgcttctcctccaacgttacccccaaaatgctggaaaacttattatcagagacaaaaaccatttcctatgtgggatgcttggtgcagtgctactttttcattgccgttgtccacgtggaggtctatatcctggctgtgatggcctttgacaggtacatggccggctgcaaccctctgctttatggcagtaaaatgtctaggactgtgtgtgttcggctcatctctgtgccttatgtctatggattctctgtcagcctaatatgcacactatggacttatggcttatacttctgtggaaactttgaaatcaatcacttctattgtgcagatccccctctcatccagattgcctgtgggagagtgcacatcaaagaaatcacaatgattgttattgctggaattaacttcacatattccctctcggtggtcctcatctcctacactctcattgtagtagctgtgctacgcatgcgctctgccgatggcaggaggaaggcgttctccacctgtgggtcccacttgacggctgtttctatgttttatgggacccccatcttcatgtatctcaggagacccactgaggaatccgtagagcagggcaaaatggtggctgtgttttacaccacagtaattcctatgttgaatcccatgatctacagtctgagaaataaggatgtaaaagaagcagtcaacaaagcaatcaccaagacatatgtgaggcagtaa

SEQ ID NO: 4553 - DNA, 1069 bp, Homo sapiens
gggttcatttagtcagcagctacttcgtctcatgaattccctgaaggacgggaatcacaccgctctgacggggttcatcctattgggcttaacagatgatccaatccttcgagtcatcctcttcatgatcatcctatctggtaatctcagcataattattcttatcagaatttcttctcagctccatcatcctatgtatttctttctgagccacttggcttttgctgacatggcctattcatcttctgtcacacccaacatgcttgtaaacttcctggtggagagaaatacagtctcctaccttggatgtgccatccagcttggttcagcggctttctttgcaacagtcgaatgcgtccttctggctgccatggcctatgaccgctttgtggcaatttgcagtccactgctttattcaaccaaaatgtccacacaagtcagtgtccagctactcttagtagtttacatagctggttttctcattgctgtctcctatactacttccttctattttttactcttctgtggaccaaatcaagtcaatcattttttctgtgatttcgctcccttacttgaactctcctgttctgatatcagtgtctccacagttgttctctcattttcttctggatccatcattgtggtcactgtgtgtgtcatagccgtctgctacatctatatcctcatcaccatcctgaagatgcgctccactgaggggcaccacaaggccttctccacctgcacttcccacctcactgtggttaccctgttctatgggaccattaccttcatttatgtgatgcccaattttagctactcaactgaccagaacaaggtggtgtctgtgttgtacacagtggtgattcccatgttgaaccccctgatctacagcctcaggaacaaggagattaagggggctctgaagagagagcttgttagaaaaatactttctcatgatgcttgttattttagtagaacttcaaataatgatattacatagaaccctatctcttctcttgagaatactcaatgcacgtgtagatacagatttagtgtttgctttcttgac

SEQ ID NO: 4554 - DNA, 936 bp, Homo sapiens
atggggactggaaatgacaccactgtggtagagtttactcttttggggttatctgaggatactacagtttgtgctattttatttcttgtgtttctaggaatttatgttgtcaccttaatgggtaatatcagcataattgtattgatcagaagaagtcatcatcttcatacacccatgtacattttcctctgccatttggcctttgtagacattgggtactcctcatcagtcacacctgtcatgctcatgagcttcctaaggaaagaaacctctctccctgttgctggttgtgtggcccagctctgttctgtagtgacgtttggtacggccgagtgcttcctgctggctgccatggcctatgatcgctatgtggccatctgctcacccctgctctactctacctgcatgtcccctggagtctgcatcatcttagtgggcatgtcctacctgggtggatgtgtgaatgcttggacattcattggctgcttattaagactgtccttctgtgggccaaataaagtcaatcactttttctgtgactattcaccacttttgaagcttgcttgttcccatgattttacttttgaaataattccagctatctcttctggatctatcattgtggccactgtgtgtgtcatagccatatcctacatctatatcctcatcaccatcctgaagatgcactccaccaagggccgccacaaggccttctccacctgcacctcccacctcactgcagtcactctgttctatgggaccattaccttcatttatgtgatgcccaagtccagctactcaactgaccagaacaaggtggtgtctgtgttctacaccgtggtgattcccatgttgaaccccctgatctacagcctcaggaacaaggagattaagggggctctgaagagagagcttagaataaaaatattttcttga

SEQ ID NO: 4555 - DNA, 975 bp, Homo sapiens
atggctgaagttaatatcatttatgtcactgtattcattctgaaaggaattaccaaccggccagagcttcaggccccgtgctttggggtgtttttagttatctatctggtcacagtgctgggcaatcttgggttgattactttaatcaagattgatactcgactccacacacctatgtactatttcctcagccacctggcctttgttgacctttgttactcctctgctattacaccgaagatgatggtgaattttgttgtggaacgcaacaccattcctttccatgcttgtgcaacccaactgggttgttttctcaccttcatgatcactgagtgtttccttctagcctccatggcctacgattgctatgtcgccatctgtagtcccctgcattattcaacactgatgtcaagaagagtctgcattcaactggtggcagttccatatatatacagcttcctggttgccctcttccacaccgttatcactttccgtctgacttactgtggcccaaacttaattaaccatttctattgtgatgacctccccttcttagctctgtcctgctcagacacacacatgaaggaaattctgatatttgcctttgctggctttgatatgatctcttcctcttccattgtcctcacctcctacatctttattattgccgctatcctaaggatccgctctactcaggggcaacacaaagccatttccacctgtggctcccatatggtgactgtcactattttctatggcacactgatctttatgtacctacagcccaaatcaaatcactccttggacacagacaagatggcttctgtattttacacagtggtgatccccatgttaaaccccctaatctatagtctaaggaacaaagaagtgaaagatgcctcaaagaaagccttggataaaggttgtgaaaacttacagatattaacatttttaaaaataagaaaactttattaa

SEQ ID NO: 4556 - DNA, 1118 bp, Homo sapiens
tttccaagaaacgaacatgaggatataattggataaacttaattttcacaggctgttgcatttagtacatataaacaatagctaaaatgtcagggttgccttcagatatggatctatacaagcttcaattaaacaattttactgaagtcaccatgtttatattaataagcttcacagaagaatttgatgtgcaagtcttcctatttttattatttttagcaatctatctattcactctaataggcaatttagggctggttgtaccgatcattggggatttctggcttcacagcccaatgtactattttcttggtgttttatcattcttggatgtctgctattctacagttgtcactccaaaaatgttggtcaatttcctggcaaaaaataaatctatttcatttcttggatgtgcaacacagatgtttcttgcttgtacttttggaaccacagaatgctttctcttggctgcaatggcttatgatcgctatgtagccatctacaaccctctcctgtattcagtgagcatgtcacccagagtctatgtgccactcatcactgcttcctatgttgctagcattttacatgctactatacatacagtggctacatttagcctgtccttctgtggatccaatgaaattaggcatgtcttttgtaatatgcctcctctgcttgctatttcttgttctgacactcacgtaatccagcttctattcttctactttgtgggctctattgagatagtcactatcctgattgtcctgatctcctatggttttattctgttggccattctgaagatgcagtctgctgaagggaggagaaaagtcttctctacatgtggagctcacctaactggagtgacaatttatcatgggacaatcctcttcatgtatgtgagaccaagttccagctacacttcggacaatgacatgatagtgtcaatattttataccattgtgattcccatgctgaatcccatcatctacagtttgcggaacaaagatgtaaaggaggcaatcaaaagattgcttgtgagaaattggttcataaataagttatagttttaaaattgagtaaagttgcaaataatattgggtgtcagtccacatctc

SEQ ID NO: 4557 - DNA, 1248 bp, Homo sapiens
gtggcatgaacacatggctgaccagtttgtcactgtcttctgattcactactagagaattatgcactgctgaatatatgtcgtacagtatatacaagagcacagttaacatccccttgagtcatggtgttgttcattctttttgtcataatatgaactgtaactttatgcatatcttcaagtttgttctagatttcaacatgaagaatgtcactgaagttaccttatttgtactgaagggcttcacagacaatcttgaactgcagactatcttcttcttcctgtttctagcaatctacctcttcactctcatgggaaatttaggactgattttagtggtcattagggattcccagctccacaaacccatgtactattttctgagtatgttgtcttctgtggatgcctgctattcctcagttattaccccaaatatgttagtagattttacgacaaagaataaagtcatttcattccttggatgtgtagcacaggtgtttcttgcttgtagttttggaaccacagaatgctttctcttggctgcaatggcttatgatcgctatgtagccatctacaaccctctcctgtattcagtgagcatgtcacccagagtctacatgccactcatcaatgcttcctatgttgctggcattttacatgctactatacatacagtggctacatttagcctatccttctgtggagccaatgaaattaggcgtgtcttttgtgatatccctcctctccttgctatttcttattctgacactcacacaaaccagcttctactcttctactttgtgggctctatcgagctggtcactatcctgattgttctgatctcctatggtttgattctgttggccattctgaagatgtattctgctgaagggaggagaaaagtcttctccacatgtggagctcacctaactggagtgtcaatttattatgggacaatcctcttcatgtatgtgagaccaagttccagctatgcttcggaccatgacatgatagtgtcaatattttacaccattgtgattcccttgctgaatcccgtcatctacagtttgaggaacaaagatgtaaaagactcaatgaaaaaaatgtttgggaaaaatcaggttatcaataaagtatattttcatactaaaaaataaattataaaaggtgagggtgatactctgcacctcaataccaagaatgtgtcattgtggtgttatgatatatgttggtttccatccagggttcc

SEQ ID NO: 4558 - DNA, 1023 bp, Homo sapiens
atggactccactttcacaggctataacctttataacctgcaagtaaaaactgaaatggacaagttgtcatcaggtttggatatatacaggaatccactgaagaacaagactgaagtcaccatgtttatattgacaggcttcacagatgattttgagctgcaagtcttcctatttttactattttttgcaatctatctctttaccttgataggcaatttagggctggttgtgttggtcattgaggattcctggctccacaaccccatgtattattttcttagtgttttatcattcttggatgcttgctattctacagttgtcactccaaaaatgttggtcaatttcctggcaaaaaataaatccatttcatttatcggatgtgcaacacagatgcttctttttgttacttttggaactacagaatgttttctcttggctgcaatggcttatgatcactatgtagccatctacaaccctctcctgtattcagtgagcatgtcacccagagtctatgtgccactcatcactgcttcctacgttgctggcattttacatgctactatacatatagtggctacatttagcctgtccttctgtggatccaatgaaattaggcatgtcttttgtgatatgcctcctctccttgctatttcttgttctgacactcacacaaaccagcttctactcttctactttgtgggttctattgagatagtcactatcctgattgtcctcatttcctgtgatttcattctgttgtccattctgaagatgcattctgctaagggaaggcaaaaggccttctctacatgtggctctcacctaactggagtgacaatttatcatggaacaattctcgtcagttatatgagaccaagttccagctatgcttcagaccatgacatcatagtgtcaatattttacacaattgtgattcccaagttgaatcccatcatctatagtttgaggaacaaagaagtaaaaaaggcagtgaagaaaatgttgaaattggtttacaaatga

SEQ ID NO: 4559 - DNA, 1117 bp, Homo sapiens
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttctctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4560 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttctctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4561 - DNA, 1117 bp, Homo sapiens
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4562 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgacatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4563 - DNA, 1266 bp, Homo sapiens
gagctgaaggtaggaaattccaacattctgaagtcttcagcaaatcttagcagatcatctcctcctcacagtcctgtctttagagaacagggtcgatatttcggcttctgcgaactcagatgtcatcttttcttccctaaagtttttaaagttcctattgatatattcccctgcctagagggtttggtggtcgttttcttcctcttaactttattaaggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4564 - DNA, 1117 bp, Homo sapiens
gaaatacgttgtgaacttcccagcacatctgttagaaaggaggtccagaaaaagagcacaaagagaatggtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4565 - DNA, 1048 bp, Homo sapiens
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttctctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4566 - DNA, 1048 bp, Homo sapiens
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcatttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4567 - DNA, 1048 bp, Homo sapiens
gtcatgctattgcagcatatgattcatttttataatctggtcttctctttgcccaattcctgaaaggaaaccaggcgacatcatggaaagaaagaatcaaacagctataactgaattcatcatcttgggattctccaacctaaatgaattgcagtttttactattcaccatcttctttctgacttatttctgtactttgggaggaaatatattaattatcttgacgactgtgactgatccacacctgcatacacctatgtattattttctagggaacttggcctttattgacatctgctacaccaccagcaatgtcccccagatgatggtgcacctcctctcaaagaaaaaaagcatttcttatgtggggtgtgtggttcaactttttgcgtttgttttctttgtaggatcagagtgtctcctactggcagcaatggcatatgatcgttacattgcaatctgcaatcctttaaggtattcagttattctgagcaaggttctatgcaatcaattagcagcctcatgctgggctgctggtttccttaactcagtggtgcatacagtgttgacattctgcctgcccttctgtggcaacaatcagattaattacttcttctgtgacatcccccctttgctgatcttgtcttgtggaaacacttctgtcaatgagttggcactgctatccactggggtcttcattggttggactcctttcctttgtatcgtactttcctacatttgcataatctccaccatcttgaggatccagtcctcagagggaagacgaaaagccttttctacatgtgcctcccacctggccattgtctttctcttttatggcagcgccatctttacatatgtacggcccatctcaacttactcattaaagaaagataggttggtttcagtgttgtacagtgttgttacccccatgctaaaccctataatttacacattgaggaataaggacatcaaagaagctgtcaaaactatagggagcaagtggcagccaccaatttcctctttggatagtaaactcacttattga

SEQ ID NO: 4568 - DNA, 933 bp, Homo sapiens
atggactgggaaaattgctcctcattaactgatttttttctcttgggaattaccaataacccagagatgaaagtgaccctatttgctgtattcttggctgtttatatcattaatttctcagcaaatcttggaatgatagttttaatcagaatggattaccaacttcacacaccaatgtatttcttcctcagtcatctgtctttctgtgatctctgctattctactgcaactgggcccaagatgctggtagatctacttgccaagaacaagtcaatacccttctatggctgtgctctgcaattcttggtcttctgtatctttgcagattctgagtgtctactgctgtcagtgatggcctttgatcggtacaaggccatcatcaaccccctgctctatacagtcaacatgtctagcagagtgtgctatctactcttgactggggtttatctggtgggaatagcagatgctttgatacatatgacactggccttccgcctatgcttctgtgggtctaatgagattaatcatttcttctgtgatatccctcctctcttattactctctcgctcagatacacaggtcaatgagttagtgttattcaccgtctttggttttattgaactgagtaccatttcaggagttttcatttcttattgttatatcatcctatcagtcttggagatacactctgctgaggggaggttcaaagctctctctacatgcacttcccacttatctgcggttgcaattttccagggaactctgctctttatgtatttccggccaagttcttcctattctctagatcaagataaaatgacctcattgttttacacccttgtggttcccatgttgaaccccctgatttatagcctgaggaacaaggatgtgaaagaggccctgaaaaaactgaaaaataaaattttattttaa

SEQ ID NO: 4569 - DNA, 942 bp, Homo sapiens
atgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgggcccatgtactattttctttccatgttggctatgtcagacttgggtttgtctttatcatctctgcccactgtgttaagcatcttcctgttcaatgcccctgaaacttcttctagtgcctgctttgcccaggaattcttcattcatggattctcagtactggagtcctcagtcctcctgatcatgtcatttgatagattcctagccatccacaatcctctgagatacacctcaatcctgacaactgtcagagttgcccaaatagggatagtattctcctttaagagcatgctcctggttcttcccttccctttcactttaagaagcttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtaccgggaattgcatccaaaaaggaggagcttaaggctctcaatacttgtgtttcacacatctgtgcagtgatcatcttctacctgcccatcatcaacctggccgttgtccaccgctttgccgggcatgtctctcccctcattaatgttctcatggcaaatgttctcctacttgtacctccgctgatgaaaccaattgtttattgtgtaaaaactaaacagattagagtgagagttgtagcaaaattgtgtcaatggaagatttaa

SEQ ID NO: 4570 - DNA, 1002 bp, Homo sapiens
tcatagcagagccctatgaatgaatcatgtccattatcaacacatcatatgttgaaatcaccaccttcttcttggttgggatgccagggctagaatatgcacacatctggatctctatccccatctgcagcatgtatcttattgctattctaggaaatggcaccattctttttatcatcaagacagagccctccttgcatgagcccatgtactattttctttccatgttggctatgtcagacttgggtttgtctttatcatctctgcccactgtgttaagcatcttcctgttcaatgctcctgaaatttcatccaatgcctgctttgcccaggaattcttcattcatggattctcagtactggagtcctcagtcctcctgatcatgtcatttgatagattcctagccatccacaaccctctgagatacacctcaatcctgacaactgtcagagttgcccaaatagggatagtattctcctttaagagcatgctcctggttcttcccttccctttcactttaagaaacttgagatattgcaagaaaaaccaattatcccattcctactgtctccaccaggatgtcatgaagttggcctgttctgacaacagaattgatgttatctatggcttttttggagcactctgccttatggtagactttattctcattgctgtgtcttacaccctgatcctcaagactgtactgggaattgcatccaaaaaggagcagcttaaggctctcaatacttgtgtttcacacatctgtgcagtgatcatcttctacctgcccatcatcaacctggccgttgtccaccgctttgcccggcatgtctctcccctcattaatgttctcatggcaaatgttctcctacttgtacctccactgacgaacccaattgtttattgtgtaaaaactaaacagattagagtgagagttgtagcaaaattgtgtcaacggaagatttaacagtcatatgtgacagaaaacctggaaatgtctg

SEQ ID NO: 4571 - DNA, 939 bp, Homo sapiens
atgtctgttctcaataactccgaagtcaagcttttccttctgattgggatcccaggactggaacatgcccacatttggttctccatccccatttgcctcatgtacctgcttgccatcatgggcaactgcaccattctctttattataaagacagagccctcgcttcatgagcccatgtattatttccttgccatgttggctgtctctgacatgggcctgtccctctcctcccttcctaccatgttgagggtcttcttgttcaatgccatgggaatttcacctaatgcctgctttgctcaagaattcttcattcatggattcactgtcatggaatcctcagtacttctaattatgtctttggaccgctttcttgccattcacaatcccttaagatacagttctatcctcactagcaacagggttgctaaaatgggacttattttagccattaggagcattctcttagtgattccatttcccttcaccttaaggagattaaaatattgtcaaaagaatcttctttctcactcatactgtcttcatcaggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttggggaagttgcttaatgtatgtgggagataa

SEQ ID NO: 4572 - DNA, 891 bp, Homo sapiens
ttccttctgattgggatcccaggactggaacatgcccacatttggttctccatccccatttgcctcatgtacctgcttgccatcatgggcaactgcaccattctctttattataaagacagagccctcgcttcatgagcccatgtattatttccttgccatgttggctgtctctgacatgggcctgtccctctcctcccttcctaccatgttgagggtcttcttgttcaatgccatgggaatttcacctaatgcctgctttgctcaagaattcttcattcatggattcactgtcatggaatcctcagtacttctaattatgtctttggaccgctttcttgccattcacaatcccttaagatacagttctatcctcactagcaacagggttgctaaaatgggacttattttagccattaggagcattctcttagtgattccatttcccttcaccttaaggagattaaaatattgtcaaaagaatcttctttctcactcatactgtcttcatcaggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttgggcatttactgtcat

SEQ ID NO: 4573 - DNA, 957 bp, Homo sapiens
atgtctgttctcaataactccgaagtcaagcttttccttctgattgggatcccaggactggaacatgcccacatttggttctccatccccatttgcctcatgtacctgcttgccatcatgggcaactgcaccattctctttattataaagacagagccctcgcttcatgagcccatgtattatttccttgccatgttggctgtctctgacatgggcctgtccctctcctcccttcctaccatgttgagggtcttcttgttcaatgccatgggaatttcacctaatgcctgctttgctcaagaattcttcattcatggattcactgtcatggaatcctcagtacttctaattatgtctttggaccgctttcttgccattcacaatcccttaagatacagttctatcctcactagcaacagggttgctaaaatgggacttattttagccattaggagcattctcttagtgattccatttcccttcaccttaaggagattaaaatattgtcaaaagaatcttctttctcactcatactgtcttcatcaggataccatgaagctggcctgctctgacaacaagaccaatgtcatctatggcttcttcattgctctctgtactatgctggacttggcactgattgttttgtcttatgtgctgatcttgaagactatactcagcattgcatctttggcagagaggcttaaggccctaaatacctgtgtctcccacatctgtgctgtgctcaccttctatgtgcccatcatcaccctggctgccatgcatcactttgccaagcacaaaagccctcttgttgtgatccttattgcagatatgttcttgttggtgccgccccttatgaaccccattgtgtactgtgtaaagactcgacaaatctgggagaagatcttggttacatttagatttattaagactgtcaaaaagttttggaaaaggtag

SEQ ID NO: 4574 - DNA, 1042 bp, Homo sapiens
ggaggctcctggtttcaaggtttcaagaaatctgatctttaccggtggatacactatgtggcccaatattactgcagccccttttttgctgactggctttccagggctggaggcagctcatcactggatctccatccccttctttgctgtttatgtgtgcatccttctgggcaatggcatgctcctctacctcatcaagcatgaccacagtcttcatgagcccatgtactacttcctcaccatgctggcaggcacagacctcatggtgacattgaccacgatgcctactgtaatgggcatcctatgggtgaatcacagggagattagcagtgtgggctgcttcctacaggcttactttattcactccctttctgttgtggaatcaggttccctcctggcaatggcatatgattgtttcattgccatccgcaatcctttgagatatgcttccattctcaccaatactagagtcatagcgttaggagtgggagtgtttctaaggggttttgtatccatcctgcctgtaattttgcgtcttttttcattttcatattgcaaatctcatgttatcacacgtgctttctgcctccaccaagaaatcatgagactggcttgtgctgacataactttcaatagactttaccctgtaattttgatctctttaacaatcttcctagactgtctgatcatcctcttctcctatattctaattcttaatactgtcataggcattgcttctggtgaagagagagccaaagccctcaatacctgtatctcccacattagttgtgttcttatcttctatgttacagtgatgggtttgacattcatttacagatttgggaagaatgtgccagaggttgtccacattatcatgagttacatctacttcctctttcctcctttaatgaaccctgtcatctacagcatcaaaaccaagcaaatacaatatggcattatccgccttttatctaaacataggtttagtagttaaactcggatctggagaatcagacacagacataaaaatgaagccagaatg

SEQ ID NO: 4575 - DNA, 983 bp, Homo sapiens
ttggaggtcatcacccctaaaaaatatcttctccacctgcaaaacctaccatgtggtataacaacagtgctggccccttcttgctgactggcttcttgggctcagaggcagttcactaccggatctctatgtccttctttgtcatctacttctccgtcctttttggaaatggcactcttcttgtcctcatttggaatgatcacagcctccatgagcccatgtactacttcctggctatgctggcagacacggaccttgggatgacattcactacaatgcccacagtcctgggtgtcctgctgctagaccagagggagattgcccatgctgcctgtttcacccaatccttcattcattcactggccattgtagaatcaggtatcttgcttgttttggcctatgactgtttcattgccatccgcacaccactgaggtacaactgcattcttaccaattcccgagtgatgaacataggactgggggtactgatgagaggttttatgtccattttgcccataattctttcactctactgctacccatattgtggttcccgtgccctcttgcacacattttgcctccatcaagatgtcataaaactcgcctgtgctgatatcacgtttaatcacatatatccaattattcagacttctttgactgtctttttagatgctctaatcatcatcttttcttatatactaatcctcaagacagtgatgggcattgcgtctggacaagaggaagctaaatctctcaacacttgtgtctcccatattagctgtgtcctagtatttcacatcactgtgatgggactgtcattcattcacaggtttgggaaacatgcacctcatgtggtccccattaccatgagctatgtccattttctctttcctccattcgtgaatcctatcatttatagcatcaagaccaagcagattcaaagaagcattattcgcctattttctgggcagagtagggcttga

SEQ ID NO: 4576 - DNA, 1066 bp, Homo sapiens
tgtgcactgtggtaataacagaaacagaaagacatttcttctatataaacccaggatgtcgtccagcggcagctcccatcccttcctattgactggttttccaggcttggaggaagctcatcactggatttccgtatttttcttgttcatgtatatatccatcctttttggcaatggcaccctccttcttctcattaaggaagatcacaatcttcatgagcccatgtacttctttctggccatgctggctgccacagacctggggctggccctgaccacaatgcccacggtgctgggagtcctctggctggatcacagggagattggaagtgcggcctgcttttcccaggcctactttatacactcactttcctttctcgagtctggcattctgcttgccatggcctatgaccgttttattgccatctgcaaccctcttagatatacctctgtacttactaatactcgagtagtgaagattgggctgggagttctgatgaggggatttgtatccgttgttcccccaatcaggcccctctatttttttctgtattgtcactcccatgttctttcacatgcattctgccttcaccaggatgtcattaaactcgcctgtgctgataccaccttcaaccgactgtacccagctgtgcttgtagtctttatatttgtgctggattatctgattatcttcatctcctatgtgttgatactcaagactgtcctgagcattgcctccagagaggagagggccaaggctctcattacctgtgtctcccatatctgctgtgtcctggttttttatgtcacagtgattggattgtctctgattcatcgttttggaaagcaggttccacatattgttcacctcattatgagctatgcctattttctgttccctccactaatgaatcctataacatatagtgtcaagaccaagcagattcagaatgccattcttcacctttttactacccatagaattggaacctgatctccaatcatcacagtcactctcacagaatgtaaaaactctaatatttagcaggagagcaaagaagtctca

SEQ ID NO: 4577 - DNA, 939 bp, Homo sapiens
atggggctcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtactatttcttagctatgttggcagctacagacctcggagtgacattgaccacaatgcccacagtgctaggtgttctgtggttagatcacagggagattggccatggagcctgcttctctcaggcctattttatccatactctttctgtcatggagtcaggtgtcttgcttgccatggcttatgactgtttcattaccatccgcagccccttaagatatacctctatcctgaccaacacccaggtaatgaagattggtgtgcgggtattgacaagggctggtctgtccattatgccaatagttgttcgcctacactggtttccctactgtcgatcccatgtactctcccatgctttctgtctacaccaagatgtcatcaagctagcctgtgctgacatcaccttcaaccgtctctatccagttgtagttttatttgcaatggtcttgttggactttctcatcatctttttctcctacattttgattctcaagactgtcatgggcattggttctggaggagaaagggccaaggccctcaacacatgtgtctctcatatctgctgcatcctggtcttctatgtcactgtagtttgtctgacatttattcataggtttggaaagcatgttcctcatgtcgttcacatcacaatgagctacatccacttccttttcccaccttttatgaacccatttatctatagcattaaaactaagcagattcagagtggcatacttcgtttattctctctgcctcactctagagcatga

SEQ ID NO: 4578 - DNA, 915 bp, Homo sapiens
gtcagcacaagccagtctcatgatttcttgcttactggcttcccaggcatggagaaggcacatcactggatattcatcccattattggcagcctacatctccatacttcttggcaatggcactcttctctttctcatcaggaatgatcataacctccatgagcccatgtactatttcttagctatgttggcagctacagacctcggagtgacattgaccacaatgcccacagtgctaggtgttctgtggttagatcacagggagattggccatggagcctgcttctctcaggcctattttatccatactctttctgtcatggagtcaggtgtcttgcttgccatggcttatgactgtttcattaccatccgcagccccttaagatatacctctatcctgaccaacacccaggtaatgaagattggtgtgcgggtattgacaagggctggtctgtccattatgccaatagttgttcgcctacactggtttccctactgtcgatcccatgtactctcccatgctttctgtctacaccaagatgtcatcaagctagcctgtgctgacatcaccttcaaccgtctctatccagttgtagttttatttgcaatggtcttgttggactttctcatcatctttttctcctacattttgattctcaagactgtcatgggcattggttctggaggagaaagggccaaggccctcaacacatgtgtctctcatatctgctgcatcctggtcttctatgtcactgtagtttgtctgacatttattcataggtttggaaagcatgttcctcatgtcgttcacatcacaatgagctacatccacttccttttcccaccttttatgaacccatttatctatagcattaaaactaagcagattcagagtggcatacttcgtttattctct

SEQ ID NO: 4579 - DNA, 939 bp, Homo sapiens
atgaccaataatatcacctccacttccatcattttcctgctcactggtgttcctgggctggaagccttccacacctggatctccattcccttctgcttcctctctgtaactgctctcttgggaaacagcctgatcctcttcgctaccatcactcagcccagcctccacgaaccaatgtactatttcctctccatgctgtccgccactgacctcggcctgtccatatccactctggtcaccatgctgagtatattctggttcaatgtgagggaaatcagctttaatgcctgcttgtcccacatgttctttattaaattcttcactgtcatggaatcctcagtgctgttggccatggcttttgatcgttttgtggccgtctctaatccccttaggtatgccatgattttaactgactccagaatagctcaaattggagtggcaagtgtcatcagggggctcctaatgctgacaccaatggtagcacttcttataagactttcctactgccacagccaagtactccaccactcctactgctaccaccctgatgtgatgaagctctcatgcacagacaccagaatcaacagtgcagttgggctgactgccatgttctctactgttggtgtagacttacttctcatcctcctttcttatgttttgatcattaggactgtccttagcgttgcttccccagaagagaggaaggaaaccttcagtacatgtgtctcccacattgtggcttttgctatatattacattccattgatcagtctgtccattgttcacagatttgggaaacaagccccagcctatgtacatactatgattgctaacacctacctgctgatctcccctttgatgaaccctgtcatctacagtgtgaaaaccaaacagatacgtagagctgtgataaaaattctccattccaaagaaacataa

SEQ ID NO: 4580 - DNA, 1124 bp, Homo sapiens
cctttctctcctctgagccacaactaaatgatgtttctacttttccctttctactttcctagaccctggattttgtatgcagaagccccagctcttggtccctatcatagccacttcaaatggaaatctggtccacgcagcatacttccttttggtgggtatccctggcctggggcctaccatacacttttggctggctttcccactgtgttttatgtatgccttggccaccctgggtaacctgaccattgtcctcatcattcgtgtggagaggcgactgcatgagcccatgtacctcttcctggccatgctttccactattgacctagtcctctcctctatcaccatgcccaagatggccagtcttttcctgatgggcatccaggagatcgagttcaacatttgcctggcccagatgttccttatccatgctctgtcagccgtggagtcagctgtcctgctggccatggcttttgaccgctttgtggccatttgccacccattgcgccatgcttctgtgctgacagggtgtactgtggccaagattggactatctgccctgaccagggggtttgtattcttcttcccactgcccttcatcctcaagtggttgtcctactgccaaacacatactgtcacacactccttctgtctgcaccaagatattatgaagctgtcctgtactgacaccagggtcaatgtggtttatggactcttcatcatcctctcagtcatgggtgtggactctctcttcattggcttctcatatatcctcatcctgtgggctgttttggagctgtcctctcggagggcagcactcaaggctttcaacacctgcatctcccacctctgtgctgttctggtcttctatgtacccctcattgggctctcggtggtgcataggctgggtggtcccacctccctcctccatgtggttatggctaatacctacttgctgctaccacctgtagtcaacccccttgtctatggagccaagaccaaagagatctgttcaagggtcctctgtatgttctcacaaggtggcaagtgagacaccttagtgtctcgcttctactactactacagaagatgggaatattaggatcctattgaatgccttggtg

SEQ ID NO: 4581 - DNA, 3612 bp, Homo sapiens
aattccacgcttagcaaggacctaaacagtgtcccccaaatgagagaagggaggacagaaagaacacttcaggatggaaatgggctgacacttaaccgtggagtgtctctgcaaacttcctttgccattctcctgtttgagtttgataaacctgagaagagacttggataaagaccgtcacgaagactacactaatgagtttcttctagcttttttctactcactttccctatctatccttcacattgggagttggcatgaggatcccagcagcccatcaggggaggactctagagatccctttccccattgcctctcctccccatacccccaggcatatcctcccagggcacggaagctgagaagcagtccagaaccacagtgggctagtgaggggtacctgctgatgtaccctttggacagcattctgccccaccctgcaggaagaagcagaaggagggagagggtgaggcagagaataaataaccctgaccagggaggtccaagggagtaggcggagacagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcatccatgcccaaaatgctggccatcttctggttcaattccactaccatccagtttgatgcttgtctgctacagatgtttgccatccactccttatctggcatggaatccacagtgctgctggccatggcttttgaccgctatgtggccatctgtcacccactgcgccatgccacagtacttacgttgcctcgtgtcaccaaaattggtgtggctgctgtggtgcggggggctgcactgatggcaccccttcctgtcttcatcaagcagctgcccttctgccgctccaatatcctttcccattcctactgcctacaccaagatgtcatgaagctggcctgtgatgatatccgggtcaatgtcgtctatggccttatcgtcatcatctccgccattggcctggactcacttctcatctccttctcatatctgcttattcttaagactgtgttgggcttgacacgtgaagcccaggccaaggcatttggcacttgcgtctctcatgtgtgtgctgtgttcatattctatgtacctttcattggattgtccatggtgcatcgctttagcaagcggcgtgactctccgctgcccgtcatcttggccaatatctatctgctggttcctcctgtgctcaacccaattgtctatggagtgaagacaaaggagattcgacagcgcatccttcgacttttccatgtggccacacacgcttcagagccctaggtgtcagtgatcaaacttcttttccattcagagtcctctgattcagattttaatgttaacattttggaagacagtattcagaaaaaaaatttccttaataaaaatacaactcagatccttcaaatatgaaactggttggggaatctccattttttcaatattattttcttctttgttttcttgctacatataattattaataccctgactaggttgtggttggagggttattacttttcattttaccatgcagtccaaatctaaactgcttctactgatggtttacagcattctgagataagaatggtacatctagagaacatttgccaaaggcctaagcacggcaaaggaaaataaacacagaatataataaaatgagataatctagcttaaaactataacttcctcttcagaactcccaaccacattggatctcagaaaaatgctgtcttcaaaatgacttctacagagaagaaataatttttcctctggacactagcacttaaggggaagattggaagtaaagccttgaaaagagtacatttacctacgttaatgaaagttgacacactgttctgagagttttcacagcatatggaccctgtttttcctatttaattttcttatcaaccctttaattaggcaaagatattattagtaccctcattgtagccatgggaaaattgatgttcagtggggatcagtgaattaaatggggtcatacaagtataaaaattaaaaaaaaaagacttcatgcccaatctcatatgatgtggaagaactgttagagagaccaacagggtagtgggttagagatttccagagtcttacattttctagaggaggtatttaatttcttctcactcatccagtgttgtatttaggaatttcctggcaacagaactcatggctttaatcccactagctattgcttattgtcctggtccaattgccaattacctgtgtcttggaagaagtgatttctaggttcaccattatggaagattcttattcagaaagtctgcatagggcttatagcaagttatttatttttaaaagttccataggtgattctgataggcagtgaggttagggagccaccagttatgatgggaagtatggaatggcaggtcttgaagataacattggccttttgagtgtgactcgtagctggaaagtgagggaatcttcaggaccatgctttatttggggctttgtgcagtatggaacagggactttgagaccaggaaagcaatctgacttaggcatgggaatcaggcatttttgcttctgaggggctattaccaagggttaataggtttcatcttcaacaggatatgacaacagtgttaaccaagaaactcaaattacaaatactaaaacatgtgatcatatatgtggtaagtttcattttctttttcaatcctcaggttccctgatatggattcctataacatgctttcatccccttttgtaatggatatcatatttggaaatgcctatttaatacttgtatttgctgctggactgtaagcccatgagggcactgtttattattgaatgtcatctctgttcatcattgactgctctttgctcatcattgaatcccccagcaaagtgcctagaacataatagtgcttatgcttgacaccggttatttttcatcaaacctgattccttctgtcctgaacacatagccaggcaattttccagccttctttgagttgggtattattaaattctggccattacttccaatgtgagtggaagtgacatgtgcaatttctatacctggctcataaaaccctcccatgtgcagcctttcatgttgacattaaatgtgacttgggaagctatgtgttacacagagtaaatcaccagaagcctggatttctgaaaaaactgtgcagagccaaacctctgtcatttgcaactcccacttgtatttgtacgaggcagttggataagtgaaaaataaagtactattgtgtcaagtctctgaaaa

SEQ ID NO: 4582 - DNA, 2781 bp, Homo sapiens
ctccacaccctgaagacacagtgagttagcaccaccaccaggaattggcctttcagctctgtgcctgtctccagtcaggctggaataagtctcctcatatttgcaagctcggccctcccctggaatctaaagcctcctcagccttctgagtcagcctgaaaggaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagtggtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagctgtcacatacaactttttttttttttgagatggggtctcgctctgtcaccaggctggagtgcagtggcgcgatctcggctcactgcaacctccacatcccatgttgaagtaattcttctgcctcagcctcccgagtagctgggactagaggaacgtgccaccatgactggctaattttctgtattttttagtagagacagagtttcaccatgttggccaggatggtctcgatctcctgaccttgtgatccacccgcctcagcctcccaaagtgttgggattacaggtgtgaaccactgtgcccggcctgtgtacaactttttaaatagggaatatgatagcttcgcatggtggtgtgcacctatagcccccactgcctggaaagctgaggtgggagaatcgcttgagtccaggagtttgaggttacagtgatccacgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattgcttcctgtgtaacatctgccatttatttcctcagctgtacaaatcctctgttttctctctgttacacactaacatcaatggctttgtacttgtgatgagagataaccttgccctagttgtgggcaacacatgcagaataatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacttgagtataagataaaataaaattttattttaaatttt

SEQ ID NO: 4583 - DNA, 582 bp, Homo sapiens
tcttctgggaatctccacaccctgaagacacagtgagttagcaccaccaccaggaattggcctttcagctctgtgcctgtctccagtcaggctggaataagtctcctcatatttgcaagctcggccctcccctggaatctaaagcctcctcagccttctgagtcagcctgaaaggaacaggccgaactgctgtatgggctctgggacacgtcactggaagacagccatcaagcatcatgaggtactgaggatacctcaatatcctggagaaggtagttgggactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgccctttt

SEQ ID NO: 4584 - DNA, 1136 bp, Homo sapiens
cagtgaatcttgaagtgccagagagatgttacaagtgataaactatgtattatgtgttatgttaaatgactgaaacatccctgtcttctcagtgcttccctatgtcggtcctcaataataccattgctgagcctctgatcttcctcctgatgggcattccaggcctgaaagccacccagtactggatctccatccctttttgtctcctatatgttgttgccgtctctggaaatagcatgatcctgtttgtggtcctctgtgaacggagcctccataagcctatgtactatttcctctctatgctttcagccacagacctgagcttgtccctgtgtacactttctactacccttggtgtcttctggtttgaagcccgagaaatcaacctaaatgcctgcattgcccagatgttctttctacacggatttactttcatggagtctggggttctactggccatggcctttgatcgttttgtggccatctgttacccactgagatacactaccatccttaccaatgcccgaattgccaagattgggatgagcatgttgataagaaatgttgccgtcatgttgccagtcatgctctttgtcaagaggttgtccttctgcagttctatggtcctttcacattcttactgctaccatgttgatctcatccaactctcctgcacagacaataggatcaacagcatccttggtctgtttgcgcttttgtccactacagggtttgactgcccttgcatcctgctctcctatatcctgatcattcgatctgtcctcagcattgcttcctcagaagagaggcggaaagccttcaacacctgcacatcccacatcagtgctgtttccatcttctacctccctctcatcagtttgtctcttgtccatcgctatggccattcagcacctccatttgtccacatcatcatggccaatgtctttctgctaatccctcctgtgctcaaccctattatttacagtgtaaagattaagcagattcaaaaggccattatcaaggtcttaattcagaagcactccaaatctaatcatcagctatttctgattagagataaagccatttatgaataagtgctttgctacaatggagtaattgtcccaaagtgcccacac

SEQ ID NO: 4585 - DNA, 1107 bp, Homo sapiens
ttcagccttgtcactttccaggaatctcattctatattccaggtttctgagtccaagattgtaaagctatgacaattcttcttaatagcagcctccaaagagccactttcttcctgacgggcttccaaggtctagaaggtctccatggctggatctctattcccttctgcttcatctacctgacagttatcttggggaacctcaccattctccacgtcatttgtactgatgccactctccatggacccatgtactatttcttgggcatgctagctgtcacagacttaggcctttgcctttccacactgcccactgtgctgggcattttctggtttgataccagagagattggcatccctgcctgtttcactcagctcttcttcatccacaccttgtcttcaatggagtcatcagttctgttatccatgtccattgaccgctacgtggccgtctgcaacccactgcatgactccaccgtcctgacacctgcatgtattgtcaagatggggctaagctcagtgcttagaagtgctctcctcatcctccccttgccattcctcctgaagcgcttccaatactgccactcccatgtgctggctcatgcttattgtcttcacctggagatcatgaagctggcctgctctagcatcattgtcaatcacatctatgggctctttgttgtggcctgcaccgtgggtgtggactccctgctcatctttctctcatacgccctcatccttcgcaccgtgctcagcattgcctcccaccaggagcgactccgagccctcaacacctgtgtctctcatatctgtgctgtactgctcttctacatccccatgattggcttgtctcttgtgcatcgctttggtgaacatctgccccgcgttgtacacctcttcatgtcctatgtgtatctgctggtaccaccccttatgaaccccatcatctacagcatcaagaccaagcaaattcgccagcgcatcattaagaagtttcagtttataaagtcacttaggtgtttttggaaggattaagttagagtaaagagaggaagttttggacataaagcccacaggtttctgtttgttttcagctgtgctgtggcaa

SEQ ID NO: 4586 - DNA, 1023 bp, Homo sapiens
acccaccttcccccttgtctcctcacacaatgaccctgggatccctgggaaacagcagcagcagcgtttctgctaccttcctgctgagtggcatccctgggctggagcgcatgcacatctggatctccatcccactgtgcttcatgtatctggtttccatcccgggcaactgcacaattctttttatcattaaaacagagcgctcacttcatgaacctatgtatctcttcctgtccatgctggctctgattgacctgggtctctccctttgcactctccctacagtcctgggcatcttttgggttggagcacgagaaattagccatgatgcctgctttgctcagctctttttcattcactgcttctccttcctcgagtcctctgtgctactgtctatggcctttgaccgctttgtggctatctgccaccccttgcactatgtttccattctcaccaacacagtcattggcaggattggcctggtctctctgggtcgtagtgtagcactcatttttccattaccttttatgctcaaaagattcccctattgtggctccccagttctctcacattcttattgtctccaccaagaagtgatgaaattggcctgtgccgacatgaaggccaacagcatctacggcatgtttgtcatcgtctctacagtgggtatagactcactgctcatcctcttctcttatgctctgatcctgcgcaccgtgctgtccatcgcctccagggctgagagattcaaggcccttaacacctgtgtttcccacatctgtgctgtgctgctcttctacactcccatgattggcctctctgtcatccatcgctttggaaagcaggcaccccacctggtccaggtggtcatgggtttcatgtatcttctctttcctcctgtgatgaatcccattgtctacagtgtgaagaccaaacagatccgggatcgagtgacgcatgccttttgttactaactgtgtctagtgttagagccactgtctcctgaaacgtgcccttgtttgc

SEQ ID NO: 4587 - DNA, 909 bp, Homo sapiens
atgacgaacttgaatgcatcacaggccaaccaccgtaacttcattctgacaggtatcccaggaacgccagacaagaacccatggttggcctttcccctgggatttctctacacactcacactcctgggaaatggtaccatcctagctgtcatcaaggtggagccaagtctccatgagcccacgtattacttcctttctatcttggctctcactgacgttagtctctccatgtccaccttgccctccatgctcagcatctactggtttaatgcccctcagattgtttttgatgcatgcatcatgcagatgttcttcatccatgtatttggaatagtagaatcaggagtcctagtgtccatggcctttgacagatttgtggccatccgaaacccattacactatgtttccatcctcactcacgatgttattcgaaagactggaatagctgtcctcacccgggcagtctgtgtggtattccctgtgcccttccttataaagtgcctacccttctgccattccaatgtcttgtctcattcatactgtcttcaccaaaacatgatgcggctagcttgtgccagcacccgcatcaacagcctctacggcctcatcgtcgtcatcttcacactggggctcgatgttctcctcactctactgtcttatgtactcaccctgaagactgtgctgggcattgtctccagaggtgaaaggctgaaaaccctcagcacatgcctctctcacatgtctaccgtgctcctcttctatgttccttttatgggtgctgcctccatgatccacagattttgggagcatttatcaccagtagtgcacatggtcatggctgatatatacctactgctcccgcctgtgctaaaccccattgtctacagtgtgaagaccaagcaaatttga

SEQ ID NO: 4588 - DNA, 891 bp, Homo sapiens
ctgacaggcattcctgggatacaaacaggcctcacctgggttgccctgattttctgcatcctctacatgatctccattgtaggtaacctcagcattctcactctggtgttttgggagcctgctctgcatcagcccatgtactacttcctctctatgctcgctctcaatgatctgggagtgtccttttctacacttcccactgtgatttctactttctgcttcaactacaaccatgttgcgtttaatgcttgcctggtccagatgttcttcatccacactttctccttcatggagtcaggcatactgctggccatgagcttggatcgctttgtggctatttgttatccattacgctatgtcactgtgctcactcacaaccgtatattggctatgggtctgggcatccttaccaagagtttcaccactctcttccctttcccttttgtggtgaaacgactgcccttctgcaaaggcaatgttttgcatcactcctactgtctccatccagatctcatgaaactgccttgtgcagatactaaactcaacagcatcctgggcttagccattgttctcgcaaatttcgggctggactcattgcttatcgtggtctcttatgtcttgattctttatacagtgatgggcattgcttctggagagggacggtggaaggctctcaacacatgtgtgtcacatatttgtgcagtgcttatatattatgtgcccatgattggggtgtctgtgatgcatcgtgctgccaaacatgcttctcccattgtccacacacttatgtctagcatctgccttttggtgccacctgtacttaatcccatcatctatagtgttaagacccagacaataagacagggaattctcaccttgttttcctgcaag

SEQ ID NO: 4589 - DNA, 936 bp, Homo sapiens
ggcttaagacactcaacacatccagcaacactccagctgacaggcattcctgggatacaaacaggcctcacctgggttgccctgattttctgcatcctctacatgatctccattgtaggtaacctcagcattctcactctggtgttttgggagcctgctctgcatcagcccatgtactacttcctctctatgctcgctctcaatgatctgggagtgtccttttctacacttcccactgtgatttctactttctgcttcaactacaaccatgttgcgtttaatgcttgcctggtccagatgttcttcatccacactttctccttcatggagtcaggcatactgctggccatgagcttggatcgctttgtggctatttgttatccattacgctatgtcactgtgctcactcacaaccgtatattggctatgggtctgggcatccttaccaagagtttcaccactctcttccctttcccttttgtggtgaaacgactgcccttctgcaaaggcaatgttttgcatcactcctactgtctccatccagatctcatgaaagtagcatgtggagacatccatgttaacaacatttatgggctcttggtgatcatttttacctatggtatggactcaactttcatcctgctttcctacgcattgatcctgagagccatgctggtcatcatatcccaggaacagcggctcaaggcactcaacacctgcatgtcacacatctgtgcagtgctggccttttatgtgcccataattgctgtctccatgattcaccgcttctggaaaagtgctccacctgttgttcatgtcatgatgtccaatgtctacctgtttgtaccacccatgctcaaccctatcatctacagtgtgaaaaccaaggagatccgcaaagggattctcaagttcttccataaatcccaggcctga

SEQ ID NO: 4590 - DNA, 945 bp, Homo sapiens
atgctgggtctcaatggcacccccttccagccagcaacactccagctgacaggcattcctgggatacaaacaggcctcacctgggttgccctgattttctgcatcctctacatgatctccattgtaggtaacctcagcattctcactctggtgttttgggagcctgctctgcatcagcccatgtactacttcctctctatgctcgctctcaatgatctgggagtgtccttttctacacttcccactgtgatttctactttctgcttcaactacaaccatgttgcgtttaatgcttgcctggtccagatgttcttcatccacactttctccttcatggagtcaggcatactgctggccatgagcttggatcgctttgtggctatttgttatccattacgctatgtcactgtgctcactcacaaccgtatattggctatgggtctgggcatccttaccaagagtttcaccactctcttccctttcccttttgtggtgaaacgactgcccttctgcaaaggcaatgttttgcatcactcctactgtctccatccagatctcatgaaagtagcatgtggagacatccatgttaacaacatttatgggctcttggtgatcatttttacctatggtatggactcaactttcatcctgctttcctacgcattgatcctgagagccatgctggtcatcatatcccaggaacagcggctcaaggcactcaacacctgcatgtcacacatctgtgcagtgctggccttttatgtgcccataattgctgtctccatgattcaccgcttctggaaaagtgctccacctgttgttcatgtcatgatgtccaatgtctacctgtttgtaccacccatgctcaaccctatcatctacagtgtgaaaaccaaggagatccgcaaagggattctcaagttcttccataaatcccaggcctga

SEQ ID NO: 4591 - DNA, 1070 bp, Homo sapiens
ttgtcctccagcaagtgcaactgttagaattctccaagtcagaagatctgactctgaaaagtaccctaagtttgttttgctatggggttgttcaatgtcactcaccctgcattcttcctcctgactggtatccctggtctggagagctctcactcctggctgtcagggcccctctgcgtgatgtatgctgtggcccttgggggaaatacagtgatcctgcaggctgtgcgagtggagcccagcctccatgagcccatgtactacttcctgtccatgttgtccttcagtgatgtggccatatccatggccacactgcccactgtactccgaaccttctgcctcaatgcccgcaacatcacttttgatgcctgtctaattcagatgtttcttattcacttcttctccatgatggaatcaggtattctgctggccatgagttttgaccgctatgtggccatttgtgaccccttgcgctatgcaactgtgctcaccactgaagtcattgctgcaatgggtttaggtgcagctgctcgaagcttcatcacccttttccctcttccctttcttattaagaggctgcctatctgcagatccaatgttctttctcactcctactgcctgcacccagacatgatgaggcttgcctgtgctgatatcagtatcaacagcatctatggactctttgttcttgtatccacctttggcatggacctgttttttatcttcctctcctatgtgctcattctgcgttctgtcatggccactgcttcccgtgaggaacgcctcaaagctctcaacacatgtgtgtcacatatcctggctgtacttgcattttatgtgccaatgattggggtctccacagtgcaccgctttgggaagcatgtcccatgctacatacatgtcctcatgtcaaatgtgtacctatttgtgcctcctgtgctcaaccctctcatttatagcgccaagacaaaggaaatccgccgagccattttccgcatgtttcaccacatcaaaatatgactttcacacttggctttagaatctgttattttggccataggctctcatca

SEQ ID NO: 4592 - DNA, 951 bp, Homo sapiens
atgaaaatttctaataactctttggggtttttacctacgactttcattttggttggcatcccagggctggagtcagagcacctctggatatccgtccccttctccctgatatacatcatcattttccttgggaatggcatcattcttcacgtcatcagaacagatattgccctacatcaacccatgtacctcttccttgccatgttggcactggccgaggttcgtgtctctgcatccaccctgcctacagtgttaggcatattcctttttggaaatactgaaattagtcttgaagcttgtctttttccagatgttctccatccattctttatccatgatggagccagctgtgctgctggccatgtctttggaccgctttatagccatctacagcccactgagctacacagctatcctgacactgcccagggtctttggcacaggagctattatcgtactgaaaagcattatgctcatggctccgttgcccattctcttatggcgtctgcccttctgtggccacaatgccctctcacattcctattgtctgcaccccaatcttatctatcttgtgggaacatttctgttaacaatatctatgggattttcattgttacctctacttttgggctggattcgttgctgattgtgatctcctatgggctcatactccacactgtattgggtattgccactggagaagggaggaagaaggcactcaacacatgtggctcacacgtctgtgctgtgcttgcttactatgtgcctatgattggcttgtctatagtgcaccgccttggacatcgtgtgtcccctctgctgcaagccatgatggccaatgcctacctcttcttcccacctgttgtcaatcctattgtctacagcattaagaccaaggagatccatggtgccattgtccgaatgctattagagaaaagacgcagagtgtag

SEQ ID NO: 4593 - DNA, 948 bp, Homo sapiens
atgggagactggaataacagtgatgctgtggagcccatatttatcctgaggggttttcctggactggagtatgttcattcttggctctccatcctcttctgtcttgcatatttggtagcatttatgggtaatgttaccatcctgtctgtcatttggatagaatcctctctccatcagcccatgtattactttatttccatcttagcagtgaatgacctggggatgtccctgtctacacttcccaccatgcttgctgtgttatggttggatgctccagagatccaggcaagtgcttgctatgctcagctgttcttcatccacacattcacattcctggagtcctcagtgttgctggccatggcctttgaccgttttgttgctatctgccatccactgcactaccccaccatcctcaccaacagtgtaattggcaaaattggtttggcctgtttgctacgaagcttgggagttgtacttcccacacctttgctactgagacactatcactactgccatggcaatgccctctctcacgccttctgtttgcaccaggatgttctaagattatcctgtacagatgccaggaccaacagtatttatgggctttgtgtagtcattgccacactaggtgtggattcaatcttcatacttctttcttatgttctgattcttaatactgtgctggatattgcatctcgtgaagagcagctaaaggcactcaacacatgtgtatcccatatctgtgtggtgcttatcttctttgtgccagttattggggtgtcaatggtccatcgctttgggaagcatctgtctcccatagtccacatcctcatggcagacatctaccttcttcttcccccagtccttaaccctattgtctatagtgtcagaacaaagcagattcgtctaggaattctccacaagtttgtcctaaggaggaggttttaa

SEQ ID NO: 4594 - DNA, 1096 bp, Homo sapiens
ttggattaaatggggcaaagagatattatttctaatgtttctttttctccctgagtgaagatcctgaatctgaagacacattcatcagtcatgtcccaggtgactaacaccacacaagaaggcatctacttcatcctcacggacatccctggatttgaggcctcccacatctggatctccatccccgtctgctgtctctacaccatctccatcatgggcaataccaccatcctcactgtcattcgcacagagccatctgtccaccagcgcatgtatctgtttctctccatgctggccctgacggacctgggtctcaccctcaccaccctacccacagtcatgcagcttctctggttcaacgttcgtagaatcagctctgaggcctgttttgctcagtttttcttccttcatggattctcctttatggagtcttctgtcctcctggctatgtccgttgactgctatgtggccatctgctgtcccctccattatgcctccatcctcaccaatgaagtcattggtagaactgggttagccatcatttgctgctgtgttctggcggttcttccctcccttttcttactcaagcgactgcctttctgccactcccaccttctctctcgctcctattgcctccaccaggatatgatccgcctggtctgtgctgacatcaggctcaacagctggtatggatttgctcttgccttgctcattattatcgtggatcctctgctcattgtgatctcctatacacttattctgaaaaatatcttgggcacagccacctgggctgagcgactccgtgccctcaataactgcctgtcccacattctagctgtcctggtcctctacattcccatggttggtgtatctatgactcatcgctttgccaagcatgcctctccactggtccatgttatcatggccaatatctacctgctggcacccccggtgatgaaccccatcatttacagtgtaaagaacaagcagatccaatggggaatgttaaatttcctttccctcaaaaatatgcattcaagatgagggaatgcatttcttaaattactgacaagtatgagtcataggcttaaggggg

SEQ ID NO: 4595 - DNA, 1088 bp, Homo sapiens
gcaaatttggcacgcgattaagtaaacctttctaatcatttttcaggttccagagttcaacgtggaatcctgaactatgtcaacattaccaactcagatagcccccaatagcagcacttcaatggcccccaccttcttgctggtgggcatgccaggcctatcaggtgcaccctcctggtggacattgcccctcattgctgtctaccttctctctgcactgggaaatggcaccatcctctggatcattgccctgcagcccgccctgcaccgcccaatgcacttcttcctcttcttgcttagtgtgtctgatattggattggtcactgccctgatgcccacactgctgggcatcgcccttgctggtgctcacactgtccctgcctcagcctgccttctacagatggtttttatccatgtcttttctgtcatggagtcctctgtcttgctcgccatgtccattgatcgggcactggccatctgccgacctctccactacccagcgctcctcaccaatggtgtaattagcaaaatcagcctggccatttcttttcgatgcctgggtctccatctgcccctgccattcctgctggcctacatgccctactgcctcccacaggtcctaacccattcttattgcttgcatccagatgtggctcgtttggcctgcccagaagcttggggtgcagcctacagcctatttgtggttctttcagccatgggtttggaccccctgcttattttcttctcctatggcctgattggcaaggtgttgcaaggtgtggagtccagagaggatcgctggaaggctggtcaaacctgtgctgcccacctctctgcagtgctcctcttctatatccctatgatcctcctggcactgattaaccatcctgagctgccaatcactcagcatacccatactcttctatcctatgtccatttccttcttcctccattgataaaccctattctctatagtgtcaagatgaaggagattagaaagagaatactcaacaggttgcagcccaggaaggtgggtggtgctcagtgagtaggatgtccctccgtgtttggtggtacagggctcctga

SEQ ID NO: 4596 - DNA, 984 bp, Homo sapiens
atggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgtgaggggtcttaggggaagatgggattga

SEQ ID NO: 4597 - DNA, 1065 bp, Homo sapiens
atgactaataaaatgtatgctatatatataaagaatcttaattatttttctttcctcatagttcagtgtcttcaaccaaccatggcaatattcaataacaccacttcgtcttcctcaaacttcctcctcactgcattccctgggctggaatgtgctcatgtctggatctccattccagtctgctgtctctacaccattgccctcttgggaaacagtatgatctttcttgtcatcattactaagcggagactccacaaacccatgtattatttcctctccatgctggcagctgttgatctatgtctgaccattacgacccttcccactgtgcttggtgttctctggtttcatgcccgggagatcagctttaaagcttgcttcattcaaatgttctttgtgcatgctttctccttgctggagtcctcggtgctggtagccatggcctttgaccgcttcgtggctatctgtaacccactgaactatgctactatcctcacagacaggatggtcctggtgatagggctggtcatctgcattagaccagcagttttcttacttccccttcttgtagccataaacactgtgtcttttcatgggggtcacgagctttcccatccattttgctaccacccagaagtgatcaaatacacatattccaaaccttggatcagcagtttttggggactgtttcttcagctctacctgaatggcactgacgtattgtttattcttttctcctatgtcctgatcctccgtactgttctgggcattgtggcccgaaagaagcaacaaaaagctctcagcacttgtgtctgtcacatctgtgcagtcactattttctatgtgccactgatcagcctctctttggcacaccgcctcttccactccaccccaagggtgctctgtagcactttggccaatatttatctgctcttaccacctgtgctgaaccctatcatttacagcttgaagaccaagacaatccgccaggctatgttccagctgctccaatccaagggttcatggggttttaatgtgaggggtcttaggggaagatgggattga

SEQ ID NO: 4598 - DNA, 966 bp, Homo sapiens
atgtttctcagttccagaatgattacttcagtaagccctagcaccagcacgaattcttcctttcttctcactggattttctggcatggagcagcaatacccctggctttccatccccttctcctcaatctatgccatggtgcttttgggcaattgcatggttctccatgtgatatggactgagccaagcctgcaccagcctatgttttacttcctgtccatgctggccctcactgacctgtgcatggggctgtccactgtgtacacagtgctggggatcctgtgggggatcattcgagagatcagcttggattcctgcattgcccagtcctatttcatccatggtctgtccttcatggagtcctctgtcctcctcactatggcctttgaccggtacattgcaatttgcaatccactacgttattcctccatcctgactaattccagaattatcaaaattgggctcactataataggtaggagttttttctttattacaccccccatcatctgtctgaaattttttaattactgtcatttccacatcctttctcactctttctgcctgcaccaggatcttctccgcttagcctgttcagacatccgattcaatagttactatgccctgatgctggttatttgcatactgttgttggatgctatactcatccttttctcctacatcctgattcttaagtcagtcctggcagttgcctctcaggaagagaggcataaattatttcagacctgcatctcccacatctgtgctgtccttgtgttctacatccctatcattagcctcacaatggtgcaccgttttggcaagcacctttcccccgtggcccacgttctcattggcaacatctacatccttttcccacctttaatgaatcccatcatctacagtgtcaagacccaacagattcataccagaatgcttagactcttttctctgaaaagatattga

SEQ ID NO: 4599 - DNA, 939 bp, Homo sapiens
atgtccatttccaacatcacagtctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgctagcagcattatgccaaagatgcttggaatattctggtttaatgtgcctgaaatctattttgattcctgcttgcttcaaatgtggttcatccacacattgcagggtatagagtcaggcatccttgtggccatggccctggaccgttatgtggccatctgttatccactaagacatgccaacatcttcacccaccagcttgtcattcagataggaactatggtcgtactcagggctgctattcttgtagccccatgcctagtactgataaagtgccggtttcaattttatcacacaacagtcatctcccactcctactgtgagcatatggccattgtgaaactagcagcagcaaatgttcaagtcaacaaaatctatggtttgtttgtggccttcactgtagcaggatttgacctcacattcatcacattgtcctacatccagatatttatcacagtttttcgtttgccccagaaggaggctaggtttaaagcattcaatacctgcattgctcacatctgtgtcttcctccagttctacctccttgccttcttctccttcttcacacataggtttgggtctcacatctccccttatatccatattctcttttctagcatttacttgctggtccctccatttctcaatccacttgtctatggtgcaaagaccacacagattcgcattcatgtggtaaaaatgttctgttcataa

SEQ ID NO: 4600 - DNA, 1779 bp, Homo sapiens
aaaagaagtataaatagttccagatttcctaatctctttgcatttattttgtctcctctcaacctgctaaatatcttcaggattctagaaaatgcaagtctggaaagaaataacagactggccagtagtccaatcccctgtccaggtgattttgctggttctaatgtatttggattgccatgcacataacatcctattatggcacagtgcctgtgaatgccccacctgaaaacagtgatgtatctccatgaatccatcttttcctttcaaaactgtgaataagatggatgattttagagttatacccaaatcagacagactcaatataatgagtttggagaaaatcagaaagcagaagaggaacagtaacactgactgagaaacttcttttgtttgcatcaggagacccaacgacactatgtccatttccaacatcacagtctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgctagcagcattatgccaaagatgcttggaatattctggtttaatgtgcctgaaatctattttgattcctgcttgcttcaaatgtggttcatccacacattgcagggtatagagtcaggcatccttgtggccatggccctggaccgttatgtggccatctgttatccactaagacatgccaacatcttcacccaccagcttgtcattcagataggaactatggtcgtactcagggctgctattcttgtagccccatgcctagtactgataaagtgccggtttcaattttatcacacaacagtcatctcccactcctactgtgagcatatggccattgtgaaactagcagcagcaaatgttcaagtcaacaaaatctatggtttgtttgtggccttcactgtagcaggatttgacctcacattcatcacattgtcctacatccagatatttatcacagtttttcgtttgccccagaaggaggctaggtttaaagcattcaatacctgcattgctcacatctgtgtcttcctccagttctacctccttgccttcttctccttcttcacacataggtttgggtctcacatctccccttatatccatattctcttttctagcatttacttgctggtccctccatttctcaatccacttgtctatggtgcaaagaccacacagattcgcattcatgtggtaaaaatgttctgttcataaaatccaccttaattaatgcctacatgcttttttcttttgcagtagtaaccatatcaaaacaaaacaaaaaacatattatttgagatgctgggtttgtgaaatctgccagcacaatagctggttttagatcatcatggctcatatcaatcagtgggattgtgaattctacgtgactaatgaaagtgagaagtgtgaaatgagtgaagtagtgaatatatattattttttctcttttattctttagcccctggttgagttattcttctaagaatatttctccaggaggatttataaattatgcctttgtcactgaatttaaatgcacctaaggctcgttgttctgaaacatccagggactcaatgaaaacaagttgttgactctcattttcttgatcatccctgccttaaaaaaaaaaatcaaa

SEQ ID NO: 4601 - DNA, 951 bp, Homo sapiens
atgccgacattcaatggctcagtcttcatgccctctgcgtttatactaattgggattcctggtctggagtcagtgcagtgttggattgggattcctttctctgccatgtatcttattggtgtgattggaaattccctaattttagttataatcaaatatgaaaacagcctccatatacccatgtacatttttttggccatgttggcagccacagacattgcacttaacacctgcattcttcccaaaatgttaggcatcttctggtttcatttgccagagatttcttttgatgcctgtctttttcaaatgtggcttattcactcattccaggcaattgaatcgggtatccttctggcaatggccctggatcgctatgtggccatctgtatccccttgagacatgccaccatcttttcccagcagttcttaactcatattggacttggggtgacactcagggctgccattcttataataccttccttagggctcatcaaatgctgtctgaaacactatcgaactacagtcatctctcactcttactgtgagcacatggccatcgtgaagctggctactgaagatatccgagtcaacaagatatatggcctatttgttgcctttgcaatcctagggtttgacataatatttataaccttgtcctatgtccaaatttttatcactgtctttcagctgccccagaaggaggcacgattcaaggcctttaatacatgcattgcccacatttgtgtcttcctacagttctaccttcttgccttcttctctttcttcacacacaggtttggttcacacataccaccatatattcatatcctcttgtcaaatctttacctgttagtcccaccttttctcaaccctattgtctatggagtgaagaccaagcaaattcgtgaccatattgtgaaagtgtttttcttcaaaaaagtaacttga

SEQ ID NO: 4602 - DNA, 1079 bp, Homo sapiens
ttcgggagtgctttctgtttctatcactttcagtagactcatcagcttctaagtcattatagagaggaccataaagtgcatcatgagtcacaccaatgttaccatcttccatcctgcagtttttgtccttcctggcatccctgggttggaggcttatcacatttggctgtcaatacctctttgcctcatttacatcactgcagtcctgggaaacagcatcctgatagtggttattgtcatggaacgtaaccttcatgtgcccatgtatttcttcctctcaatgctggccgtcatggacatcctgctgtctaccaccactgtgcccaaggccctagccatcttttggcttcaagcacataacattgcttttgatgcctgtgtcacccaaggcttctttgtccatatgatgtttgtgggggagtcagctatcctgttagccatggcctttgatcgctttgtggccatttgtgccccactgagatatacaacagtgctaacatggcctgttgtggggaggattgctctggccgtcatcacccgaagcttctgcatcatcttcccagtcatattcttgctgaagcggctgcccttctgcctaaccaacattgttcctcactcctactgtgagcatattggagtggctcgtttagcctgtgctgacatcactgttaacatttggtatggcttctcagtgcccattgtcatggtcatcttggatgttatcctcatcgctgtgtcttactcactgatcctccgagcagtgtttcgtttgccctcccaggatgctcggcacaaggccctcagcacttgtggctcccacctctgtgtcatccttatgttttatgttccatccttctttaccttattgacccatcattttgggcgtaatattcctcaacatgtccatatcttgctggccaatctttatgtggcagtgccaccaatgctgaaccccattgtctatggtgtgaagactaagcagatacgtgagggtgtagcccaccggttctttgacatcaagacttggtgctgtacctcccctctgggctcatgaatcttcatgtccagctccttcaagg

SEQ ID NO: 4603 - DNA, 1124 bp, Homo sapiens
agctcctggtgacatcgcaaagaatgttgcagattttatcttcttctacctctgtgagtaggaggtgaggttctgaaagttctccccagctatgcctactgtaaaccacagtggcactagccacacagtcttccacttgctgggcatccctggcctacaggaccagcacatgtggatttctatcccattcttcatttcctatgtcaccgcccttcttgggaacagcctgctcatcttcattatcctcacaaagcgcagcctccatgaacccatgtacctcttcctctgcatgctggctggagcagacattgtcctctccacgtgcaccattcctcaggccttagctatcttctggttccgtgctggggacatctccctggatcgttgcatcactcagctcttcttcatccattccaccttcatctctgagtcagggatcttgctggtgatggcctttgaccactatattgccatatgctacccactgaggtacaccaccattcttacaaatgctctgatcaagaaaatttgtgtgactgtctctctgagaagttatggtacaattttccctatcatatttcttttaaaaagattgactttctgccagaataatattattccacacaccttttgtgaacacattggcctagccaaatatgcatgtaatgacattcgaataaacatttggtatgggttttccattctaatgtcgacggtggtcttagatgttgtactaatttttatttcctatatgctgattctccatgctgtcttccacatgccttctccagatgcttgccacaaagctctcaacacatttggctcccatgtctgcatcatcatcctcttttatgggtctggcatcttcacaatccttacccagaggtttggacgccacattccaccttgtatccacatcccgttggctaatgtctgcattctggctccacctatgctgaatcccattatttatgggatcaaaaccaagcaaatccaggaacaggtggttcagtttttgtttataaaacagaaataactttggtttaagaactgagttttcagaatctctagctatctggtaagtgggtatgaaagtggtagatgggagaggtcagctgataccg

SEQ ID NO: 4604 - DNA, 1008 bp, Homo sapiens
atggcacaggtgagggcgctgcataaaatcatggcccttttttctgctaacagcataggtgctatgaacaactctgacactcgcatagcaggctgcttcctcactggcatccctgggctggagcaactacatatctggctgtccatccccttctgcatcatgtacatcactgccctggaaggcaatggcatcctaatttgtgtcatcctctcccaggcaatcctgcatgagcccatgtacatattcttatctatgctggccagtgctgatgtcttgctctctaccaccaccatgcctaaggccctggccaatttgtggctaggttatagcctcatttcctttgatggctgcctcactcagatgttcttcattcacttcctcttcattcactctgctgtcctgctggccatggcctttgaccgctatgtggccatctgctcccccctgcgatatgtcacaatcctcacaagcaaggtcattgggaagatcgtcactgccgccctgagccacagcttcatcattatgtttccatccatctttctccttgagcacctgcactattgccagatcaatatcattgcacacacattttgtgagcacatgggcattgcccatctgtcctgttctgatatctccatcaatgtctggtatgggttggcagctgctcttctctccacaggcctagacatcatgcttattactgtttcctacatccacatcctccaagcagtcttccgcctcctttctcaagatgcccgctccaaggccctgagtacctgtggatcccatatctgtgtcatcctactcttctatgtccctgcgcttttttctgtctttgcctacaggtttggtgggagaagcgtcccatgctatgtccatattctcctggccagcctctacgttgtcattcctcctatgctcaatcccgttatttatggagtgaggactaagccaatactggaaggggctaagcagatgttttcaaatcttgccaaaggatctaaataa

SEQ ID NO: 4605 - DNA, 1065 bp, Homo sapiens
agcccttcatttgccaggaagaatgtcagattccaacctcagtgataaccatcttccagacaccttcttcttaacagggatcccagggctggaggctgcccacttctggattgccatccctttctgtgccatgtatcttgtagcactggttggaaatgctgccctcatcctggtcattgccatggacaatgctcttcatgcacctatgtacctcttcctctgccttctctcactcacagacctggctctcagttctaccactgtgcccaagatgctggccattttgtggctccatgctggtgagatttcctttggtggatgcctggcccagatgttttgtgtccattctatctatgctctggagtcctcaattctacttgccatggcctttgataggtatgtggctatctgtaacccattaaggtacacaaccattctcaaccatgctgtcataggcagaattggctttgttgggctattccgtagtgtggctattgtctcccccttcatcttcttgctgaggcgactcccctactgtggtcaccgtgtcatgacacacacatactgtgagcatatgggcattgcccgactggcctgtgccaacatcactgtcaatattgtctatgggctaactgtggctctgctggccatgggactggattccattctcattgccatttcctatggctttatcctccatgcagtctttcatcttccatctcatgatgcccagcacaaagctctgagtacctgtggctcccacattggcatcatcctggttttctacatccctgccttcttctccttcctcacccaccgctttggtcaccacgaagtccccaagcatgtgcacatctttctggctaatctctatgtgctggtgcctcctgtactcaatcctattctctatggagctagaaccaaggagattcggagtcgacttctaaaactgcttcacctggggaagacttcaatatgaatgctgagcagaagttggagatttaaaaaaaagtgtaggatggctgtctagatacatttacatggacacacagtgatgatgtgaaa

SEQ ID NO: 4606 - DNA, 978 bp, Homo sapiens
atgttccttcccaatgacacccagtttcacccctcctccttcctgttgctggggatcccaggactagaaacacttcacatctggatcggctttcccttctgtgctgtgtacatgatcgcactcatagggaacttcactattctacttgtgatcaagactgacagcagcctacaccagcccatgttctacttcctggccatgttggccaccactgatgtgggtctctcaacagctaccatccctaagatgcttggaatcttctggatcaacctcagagggatcatctttgaagcctgcctcacccagatgttttttatccacaacttcacacttatggagtcagcagtccttgtggcaatggcttatgacagctatgtggccatctgcaatccactccaatatagcgccatcctcaccaacaaggttgtttctgtgattggtcttggtgtgtttgtgagggctttaattttcgtcattccctctatacttcttatattgcggttgcccttctgtgggaatcatgtaattccccacacctactgtgagcacatgggtcttgctcatctatcttgtgccagcatcaaaatcaatattatttatggtttatgtgccatttgtaatctagtgtttgacatcacagtcattgccctttcttatgtgcatattctttgtgctgttttccgtcttcctactcatgaagcccgactcaagtccctcagcacatgtggttcacatgtgtgtgtaatccttgccttctatacaccagccctcttttcctttatgactcatcgctttggccgaaatgtgccccgctatatccatatactcctagccaatctctatgttgtggtgccaccaatgctcaatcctgtcatatatggagtcagaaccaagcagatctataaatgtgtgaagaaaatattattgcaggaacaaggaatggaaaaggaagagtacctaatacatacgaggttctga

SEQ ID NO: 4607 - DNA, 1027 bp, Homo sapiens
ttcagtgacacttgctgggagaatgccttctatcaatgacacccacttctatccccccttcttcctcctgctaggaataccaggactggacactttacatatctggatttctttcccattctgtattgtgtacctgattgccattgtggggaatatgaccattctctttgtgatcaaaactgaacatagtctacaccagcccatgttctacttcctggccatgttgtctatgattgatctgggtctgtccacatccactatccccaaaatgctaggaatcttctggttcaacctccaagagatcagctttgggggatgccttcttcagatgttctttattcacatgtttacaggcatggagactgttctgttggtggtcatggcttatgaccgctttgttgccatctgcaaccctctccagtacaccatgatcctcaccaataaaaccatcagtatcctagcttctgtggttgttggaagaaatttagttcttgtaaccccatttgtgtttctcattctgcgtctgccattctgtgggcataacatcgtacctcacacatactgtgagcacaggggtctggccgggttggcctgtgcacccattaagatcaacataatctatgggctcatggtgatttcttatattattgtggatgtgatcttaattgcctcttcctatgtgcttatccttagagctgtttttcgccttccctctcaagatgtccgactaaaggccttcaatacctgtggttctcatgtctgtgttatgctgtgcttttacacaccagcatttttttcttttatgacacatcgttttggccaaaacattccccactatatccatattcttttggctaacctgtatgtggttgtcccacctgcccttaaccctgtcatttatggagtcaggaccaagcagatccgagagcaaattgtgaaaatatttgtacagaaagaataattctgtattaaagtttggataaatatatctatatacaacccaaattatcatcatctgagctccctt

SEQ ID NO: 4608 - DNA, 970 bp, Homo sapiens
atgcctatagctaacgacacccagttccatacttcttcattcctactgctgggtatcccagggctagaagatgtgcacatctggattggattcccttttttctctgtgtatcttattgcactcctgggaaatgctgctatcttctttgtgatccaaactgagcagagtctccatgagcccatgtactactgcctggccatgttggattccattgacctgagcttgtctacggccaccattcccaaaatgctgggcatcttctggttcaatatcaaggaaatatcttttggaggctacctttctcagatgttcttcatccatttcttcactgtcatggagagcatcgtattggtggccatggcctttgaccgctacattgccatttgcaaacctctttggtacaccatgatcctcaccagcaaaatcatcagcctcattgcaggcattgctgtcctgaggagcttgtacatggtcattccactggtgtttctcctcttaaggttgcccttctgtggacatcgtatcatccctcatacttactgtgagcacatgggcattgcccgtctggcctgtgccagcatcaaagtcaacattatgtttggtcttggcagtatttctctcttgttattggatgtgctccttattattctctcccatatcaggatcctctatgctgtcttctgcctgccctcctgggaagctcgactcaaagctctcaacacctgtggctctcacattggtgttatcttagccttttctacaccagcatttttctctttctttacacactgctttggccatgatattccccaatatatccacattttcttggctaatctatatgtggttgttcctcccaccctcaatcctgtaatctatggggtcagaaccaaacatattagggagacagtgctgaggattttcttcaagacagatcactaaccagttggagtttggagggtctctctta

SEQ ID NO: 4609 - DNA, 954 bp, Homo sapiens
atggaaaaaagaatgcctatagctaacgacacccagttccatacttcttcattcctactgctgggtatcccagggctagaagatgtgcacatctggattggattcccttttttctctgtgtatcttattgcactcctgggaaatgctgctatcttctttgtgatccaaactgagcagagtctccatgagcccatgtactactgcctggccatgttggattccattgacctgagcttgtctacggccaccattcccaaaatgctgggcatcttctggttcaatatcaaggaaatatcttttggaggctacctttctcagatgttcttcatccatttcttcactgtcatggagagcatcgtattggtggccatggcctttgaccgctacattgccatttgcaaacctctttggtacaccatgatcctcaccagcaaaatcatcagcctcattgcaggcattgctgtcctgaggagcttgtacatggtcattccactggtgtttctcctcttaaggttgcccttctgtggacatcgtatcatccctcatacttactgtgagcacatgggcattgcccgtctggcctgtgccagcatcaaagtcaacattatgtttggtcttggcagtatttctctcttgttattggatgtgctccttattattctctcccatatcaggatcctctatgctgtcttctgcctgccctcctgggaagctcgactcaaagctctcaacacctgtggctctcacattggtgttatcttagccttttctacaccagcatttttctctttctttacacactgctttggccatgatattccccaatatatccacattttcttggctaatctatatgtggttgttcctcccaccctcaatcctgtaatctatggggtcagaaccaaacatattagggagacagtgctgaggattttcttcaagacagatcactaa

SEQ ID NO: 4610 - DNA, 1061 bp, Homo sapiens
ataatcgtcgctggtgtgcccagcagctttatatggcaggaagaatgtctacgtctaatcacacccagttccatccttcttcattcctactgctgggtatcccagggctagaagatgtgcacatttggattggagtcccttttttctttgtgtatcttgttgcactcctgggaaacactgctctcttgtttgtgatccagactgagcagagtctccatgagcctatgtactacttcctggccatgttggattccattgacctgggcttgtctacagccaccatccccaaaatgttgggcatcttctggttcaataccaaagaaatatcttttggaggctgcctttctcacatgttcttcatccatttcttcactgctatggagagcattgtgttggtggccatggcctttgaccgctacattgccatttgcaaacctcttcggtacaccatgatcctcaccagcaaaatcatcagcctcattgcaggcattgctgtcctgaggagcctgtacatggttgttccactggtgtttctccttctgaggctgcccttctgtgggcatcgtatcatccctcatacttattgtgagcacatgggcattgcccgtctggcctgtgccagcatcaaagtcaacattaggtttggccttggcaacatatctctcttgttactggatgttatccttattattctctcctatgtcaggatcctgtatgctgtcttctgcctgccctcctgggaagctcgactcaaagctctcaacacctgtggttctcatattggtgttatcttagccttttttacaccagcatttttttcattcttgacacatcgttttggccataatatcccacagtatatacatattatattagccaacctgtatgtggttgtcccaccagccctcaatcctgtaatctatggagtcaggacaaagcagattcgagagagagtgctgaggatttttctcaagaccaatcactaaccagttggaggttggagagtctgtcactctaacctaatagaaagcagaaaaacagaagggaatgctgcagccaat

SEQ ID NO: 4611 - DNA, 1061 bp, Homo sapiens
ccctctgtctttaggggctgagatttatgccatctgcctctgccatgatcattttcaacctgagcagttacaatccaggacccttcattctggtagggatcccaggcctggagcaattccatgtgtggattggaattcccttctgtatcatctacattgtagctgttgtgggaaactgcatccttctctacctcattgtggtggagcatagtcttcatgaacccatgttcttctttctctccatgctggccatgactgacctcatcttgtccacagctggtgtgcctaaagcactcagtatcttttggctaggggctcgcgaaatcacattcccaggatgccttacacaaatgttcttccttcactataactttgtcctggattcagccattctgatggccatggcatttgatcactatgtagctatctgttctcccttgagatataccaccatcttgactcccaagaccatcatcaagagtgctatgggcatctcctttcgaagcttctgcatcatcctgccagatgtattcttgctgacatgcctgcctttctgcaggacacgcatcataccccacacatactgtgagcatataggtgttgcccagctcgcctgtgctgatatctccatcaacttctggtatggcttttgtgttcccatcatgacggtcatctcagatgtgattctcattgctgtttcctacgcacacatcctctgtgctgtctttggccttccctcccaagatgcctgccagaaagccctcggcacttgtggttctcatgtctgtgtcatcctcatgttttatacacctgcctttttctccatcctcgcccatcgctttggacacaatgtctctcgcaccttccacatcatgtttgccaatctctacattgttatcccacctgcactcaaccccatggtttacggagtgaagaccaagcagatcagagataaggttatacttttgttttctaagggtacaggatgatgttttactaggataagtttatagtgtacagaaatgtagaaagagtgaaatggcaaatgctctttaaagcaa

SEQ ID NO: 4612 - DNA, 1047 bp, Homo sapiens
acacaagtccctaaggactgcaccattctcttacatcatctatacattaataggcaagaagtctcacctgtgatgctgggtccagcttacaaccacacaatggaaacccctgcctccttcctccttgtgggtatcccaggactgcaatcttcacatctttggctggctatctcactgagtgccatgtacatcacagccctgttaggaaacaccctcatcgtgactgcaatctggatggattccactcggcatgagcccatgtattgctttctgtgtgttctggctgctgtggacattgttatggcctcctccgtggtacccaagatggtgagcatcttctgctcgggagacagctccatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccgtcaccatcagagctgtcacattcatgactccactgagttggatgatgaatcatctacctttctgtggctccaatgtggttgtccactcctactgtaagcacatagctttggccaggttagcatgtgctgaccccgtgcccagcagtctctacagtctgattggttcctctcttatggtgggctctgatgtggccttcattgctgcctcctatatcttaattctcagggcagtatttgatctctcctcaaagactgctcagttgaaagcattaagcacatgtggctcccatgtgggggttatggctttgtactatctacctgggatggcatccatctatgcggcctggttggggcaggatatagtgcccttgcacacccaagtgctgctagctgacctgtacgtgatcatcccagccactttaaatcccatcatctatggcatgaggaccaaacaattgctggagggaatatggagttatctgatgcacttcctctttgaccactccaacctgggttcatga

SEQ ID NO: 4613 - DNA, 972 bp, Homo sapiens
atgctgggtccagcttacaaccacacaatggaaacccctgcctccttcctccttgtgggtatcccaggactgcaatcttcacatctttggctggctatctcactgagtgccatgtacatcacagccctgttaggaaacaccctcatcgtgactgcaatctggatggattccactcggcatgagcccatgtattgctttctgtgtgttctggctgctgtggacattgttatggcctcctccgtggtacccaagatggtgagcatcttctgctcgggagacagctccatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccgtcaccatcagagctgtcacattcatgactccactgagttggatgatgaatcatctacctttctgtggctccaatgtggttgtccactcctactgtaagcacatagctttggccaggttagcatgtgctgaccccgtgcccagcagtctctacagtctgattggttcctctcttatggtgggctctgatgtggccttcattgctgcctcctatatcttaattctcagggcagtatttgatctctcctcaaagactgctcagttgaaagcattaagcacatgtggctcccatgtgggggttatggctttgtactatctacctgggatggcatccatctatgcggcctggttggggcaggatatagtgcccttgcacacccaagtgctgctagctgacctgtacgtgatcatcccagccactttaaatcccatcatctatggcatgaggaccaaacaattgctggagggaatatggagttatctgatgcacttcctctttgaccactccaacctgggttca

SEQ ID NO: 4614 - DNA, 1115 bp, Homo sapiens
ccttaggttttcccagcaccacatgtgtcaacaaatcttacgggattgcattcttctcatacatcatttgtgcattaacaggaaaaaagtctcacttgtgatgctgggtccagcttataaccacacaatggaaacccctgcctccttcctccttgtgggtatcccaggactgcaatcttcacatctttggctggctatctcactgagtgccatgtacatcatagccctgttaggaaacaccatcatcgtgactgcaatctggatggattccactcggcatgagcccatgtattgctttctgtgtgttctggctgctgtggacattgttatggcctcctcggtggtacccaagatggtgagcatcttctgctcaggagacagctcaatcagctttagtgcttgtttcactcagatgttttttgtccacttagccacagctgtggagacggggctgctgctgaccatggcttttgaccgctatgtagccatctgcaagcctctacactacaagagaattctcacgcctcaagtgatgctgggaatgagtatggccatcaccatcagagctatcatagccataactccactgagttggatggtgagtcatctacctttctgtggctccaatgtggttgtccactcctactgtgagcacatagctttggccaggttagcatgtgctgaccccgtgcccagcagtctctacagtctgattggttcctctcttatggtgggctctgatgtggccttcattgctgcctcctatatcttaattctcaaggcagtatttggtctctcctcaaagactgctcagttgaaagcattaagcacatgtggctcccatgtgggggttatggctttgtactatctacctgggatggcatccatctatgcggcctggttggggcaggatgtagtgcccttgcacacccaagtcctgctagctgacctgtacgtgatcatcccagccaccttaaatcccatcatctatggcatgaggaccaaacaactgcgggagagaatatggagttatctgatgcatgtcctctttgaccattccaacctgggttcatgaacacaatatctgttcagatccagccaatttcaaagatgcc

SEQ ID NO: 4615 - DNA, 936 bp, Homo sapiens
atgttttatcacaacaagagcatatttcacccagtcacatttttcctcattggaatcccaggtctggaagacttccacatgtggatctccgggcctttctgctctgtttaccttgtggctttgctgggcaatgccaccattctgctagtcatcaaggtagaacagactctccgggagcccatgttctacttcctggccattctttccactattgatttggccctttctacaacctctgtgcctcgcatgctgggtatcttctggtttgatgctcacgagattaactatggagcttgtgtggcccagatgtttctgatccatgccttcactggcatggaggctgaggtcttactggctatggcttttgaccgttatgtggccgtctgtgctccactacattacgcaaccatcttgacatcccaagtgttggtgggcattagcatgtgcattgtaattcgtcccgttttacttacacttcccatggtctatcttatctaccgcctacccttttgtcaggctcacataatagcccattcctactgtgagcacatgggcattgcaaaattgtcctgtggaaacattcgtatcaatggtatctatgggctttttgtagtttctttctttgttctgaacctggtgctcattggcatctcgtatgtttacattctccgtgctgtcttccgcctcccatcacatgatgctcagctaaaagccctaagcacgtgtggcgctcatgttggagtcatctgtgttttctatatcccttcagtcttctctttccttactcatcgatttggacaccaaataccaggttacattcacattcttgttgccaatctctatttgattatcccaccctctctcaaccccatcatttatggggtgaggaccaaacagattcgagaacgagtgctctatgtttttactaaaaaataa

SEQ ID NO: 4616 - DNA, 1030 bp, Homo sapiens
gacaaggagatttccaggagccatgcttccctctaatatcacctcaacacatccagctgtctttttgttggtaggaattcctggtttggaacacctgcatgcctggatctccatccccttctgctttgcttatactctggccctgctaggcaactgtacccttctcttcattatccaggctgatgcagccctccatgaacccatgtacctctttctggccatgttggcaaccattgacttggttctttcttctacaacgctgcccaaaatgcttgccatattctggttcagggatcaggagatcaacttctttgcctgtctggtccagatgttcttccttcactccttctccatcatggagtcagcagtgctgctggccatggcctttgaccgctatgtggccatctgcaagccattgcactacacgacggtcctgactgggtccctcatcaccaagattggcatggctgctgtggcccgggctgtgacactaatgactccactccccttcctgctcagacgcttccactactgccgaggcccagtgattgcccattgctactgtgaacacatggctgtggtaaggctggcgtgtggggacactagcttcaacaatatctatggcattgctgtggccatgtttattgtggtgttggacctgctctttgttatcctgtcttatgtcttcatccttcaggcagttctccagcttgcctctcaggaggcccgctacaaggcatttgggacatgtgtgtctcacataggtgccatcctgtccacctacactccagtagtcatctcttcagtcatgcaccgtgtagcccgccatgctgcccctcgtgtccacatactccttgctattttctatctccttttcccacccatggtcaatcctatcatatatggagtcaagaccaagcagattcgtgagtatgtgctcagtctattccagagaaagaacatgtagatggatagttctctttttttatcccacttgccaagtaatgagaatgctggattggggttgagg

SEQ ID NO: 4617 - DNA, 1067 bp, Homo sapiens
gggccctgtggaagcagataaggaggaagagaattcccaggagccatgtcagcctccaatatcaccttaacacatccaactgccttcttgttggtggggattccaggcctggaacacctgcacatctggatctccatccctttctgcttagcatatacactggccctgcttggaaactgcactctccttctcatcatccaggctgatgcagccctccatgaacccatgtacctctttctggccatgttggcagccatcgacctggtcctttcctcctcagcactgcccaaaatgcttgccatattctggttcagggatcgggagataaacttctttgcctgtctggcccagatgttcttccttcactccttctccatcatggagtcagcagtgctgctggccatggcctttgaccgctatgtggctatctgcaagccactgcactacaccaaggtcctgactgggtccctcatcaccaagattggcatggctgctgtggcccgggctgtgacactaatgactccactccccttcctgctgagatgtttccactactgccgaggcccagtgatcgctcactgctactgtgaacacatggctgtggtgaggctggcgtgtggggacactagcttcaacaatatctatggcatcgctgtggccatgtttattgtggtgttggacctgctccttgttatcctgtcttatatctttattcttcaggcagttctactgcttgcctctcaggaggcccgctacaaggcatttgggacatgtgtctctcatataggtgccatcttagccttctacacaactgtggtcatctcttcagtcatgcaccgtgtagcccgccatgctgcccctcatgtccacatcctccttgccaatttctatctgctcttcccacccatggtcaatcccataatctatggtgtcaagaccaagcaaatccgtgagagcatcttgggagtattcccaagaaaggatatgtagagggtgaggtggagaaagaatgggttggcttgtctgctggagttggagacaggctatggtagaatgtgcacggctgc

SEQ ID NO: 4618 - DNA, 1094 bp, Homo sapiens
ggatgatggttgccccatttggacaatgtgataatgtagcaggaatgcagaaatcatgactttggtttcttttttctctttcctctccaagccattgataatgctccttagcaattcaagctggaggctatcccagccttcttttctcctggtagggattccaggtttagaggaaagccagcactggattgcactgcccctgggcatcctttacctccttgctttagtgggcaatgttaccattctcttcatcatctggatggacccatccttgcaccaatctatgtacctcttcctgtccatgctagctgccatcgacctggttctggcctcctccactgcacccaaagcccttgcagtgctcctggttcatgcccacgagattgggtacatcgtctgcctgatccagatgttcttcatccatgcattctcctccatggagtcaggggtacttgtggccatggctctggattgctatgtagccatttgtcaccccttgcaccattccacaatcctgcatccaggggtcatagggtgcatcggaatggtggtgctggtgaggggattactactccttatccccttccccattttgttgggaaaacttatcttctgccaagccaccatcataggccatgcctattgtgaacatatggctgttgtgaaacttgcctgctcagaaaccacagtcaatcgagcttatgggctgactatggccttgcttgtgattgggctggatgttctggccattggtgtttcctatgcccacatcctccaggcagtgctgaaggtaccagggagtgaggcccgacttaaggcgtttagcacatgtggctctcatatttgtgtcatcctggtcttctatgtccctggaattttctccttcctcactcaccgctttggtcatcatgtaccccatcatgtccatgttcttctggccacatggtatctcctcatgccacctgcgctcaatcctcttgtctatggagtgaagactcagcagatccgccagcgagtgctcagagtgtttacacaaaaggattgatctgaacatattctcattgtttccttcggaggcttcttctgcggaccac

SEQ ID NO: 4619 - DNA, 954 bp, Homo sapiens
atgctcacttttcataatgtctgctcagtacccagctccttctggctcactggcatcccagggctggagtccctacacgtctggctctccatcccctttggctccatgtacctggtggctgtggtggggaatgtgaccatcctggctgtggtaaagatagaacgcagcctgcaccagcccatgtactttttcttgtgcatgttggctgccattgacctggttctgtctacttccactatacccaaacttctgggaatcttctggttcggtgcttgtgacattggcctggacgcctgcttgggccaaatgttccttatccactgctttgccactgttgagtcaggcatcttccttgccatggcttttgatcgctacgtggccatctgcaacccactacgtcatagcatggtgctcacttatacagtggtgggtcgtttggggcttgtttctctcctccggggtgttctctacattggacctctgcctctgatgatccgcctgcggctgcccctttataaaacccatgttatctcccactcctactgtgagcacatggctgtagttgccttgacatgtggcgacagcagggtcaataatgtctatgggctgagcatcggctttctggtgttgatcctggactcagtggctattgctgcatcctatgtgatgattttcagggccgtgatggggttagccactcctgaggctaggcttaaaaccctggggacatgcgcttctcacctctgtgccatcctgatcttttatgttcccattgctgtttcttccctgattcaccgatttggtcagtgtgtgcctcctccagtccacactctgctggccaacttctatctcctcattcctccaatcctcaatcccattgtctatgctgttcgcaccaagcagatccgagagagccttctccaaataccaaggatagaaatgaagattagatga

SEQ ID NO: 4620 - DNA, 963 bp, Homo sapiens
atgtcatttctaaatggcaccagcctaactccagcttcattcatcctaaatggcatccctggtttggaagatgtgcatttgtggatctccttcccactgtgtaccatgtacagcattgctattacagggaacttcggccttatgtacctcatctactgtgatgaggccttacacagacctatgtatgtcttccttgcccttctttccttcacagatgtgctcatgtgcaccagcacccttcccaacactctcttcatattgtggtttaatctcaaggagattgattttaaagcctgcctcgcccagatgttctttgtgcacaccttcacagggatggagtctggggtgctcatgctcatggccctggaccactgtgtggccatctgcttccctctgcgttatgccaccatcctcactaattcagtcattgctaaagctgggttcctcacttttcttaggggtgtgatgcttgttatcccttccactttcctcaccaagcgccttccatactgcaagggcaacgtcataccccacacctactgtgaccacatgtctgtggccaagatatcttgtggtaatgtcagggttaacgccatctatggtttgatagttgccctgctgattgggggctttgatatcctgtgcattacaatctcctacactatgattcttcaagcagttgtgagtctatcatcagcagatgctcgacagaaggccttcagcacctgcactgcccacttctgtgccatagtcctcacctatgttccagccttctttaccttctttacacaccattttgggggacacaccattcctctacacatacatattattatggctaatctctacctactaatgcctcccacaatgaaccctattgtgtatggggtgaaaaccaggcaggtacgagaaagtgtcattaggttctttcttaagggaaaggacaattctcataacttttaa

SEQ ID NO: 4621 - DNA, 1035 bp, Homo sapiens
tgctctcctcctgtcagccatcatgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaacgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcgcctgccctattgccgggggaacttcatcccccacacctactgtgaccatatgtctgtggccaaggtatcctgtggcaatttcaaggtcaatgctatttatggtctgatggttgctctcctgattggtgtgtttgatatctgctgtatctctgtatcttacactatgattttgcaggctgttatgagcctgtcatcagcagatgctcgtcacaaagccttcagcacctgcacatctcacatgtgttccattgtgatcacctatgttgctgcttttttcacttttttcactcatcgttttgtaggacacaatatcccaaaccacatacacatcatcgtggccaacctttatctgctactgcctcctaccatgaacccaattgtttatggagtcaagaccaagcagattcaggaaggtgtaattaaatttttacttggagacaaggttagttttacctatgacaaatgaaacatagaatagacatattgtttcaggtggtgagaaaataatggaga

SEQ ID NO: 4622 - DNA, 1037 bp, Homo sapiens
gaaagcccagacaaattttgagctatttcataacctaccagacttatcatgctaacactgaataaaacagacctaataccagcttcatttattctgaatggagtcccaggactggaagacacacaactctggatttccttcccattctgctctatgtatgttgtggctatggtagggaattgtggactcctctacctcattcactatgaggatgccctgcacaaacccatgtactacttcttggccatgctttcctttactgaccttgttatgtgctctagtacaatccctaaagccctctgcatcttctggtttcatctcaaggacattggatttgatgaatgccttgtccagatgttcttcacccacaccttcacagggatggagtctggggtgcttatgcttatggccctggatcgctatgtggccatctgctaccccttacgctattcaactatcctcaccaatcctgtaattgcaaaggttgggactgccaccttcctgagaggggtattactcattattccctttactttcctcaccaagctcctgccctactgcagaggcaatatacttccccatacctactgtgaccacatgtctgtagccaaattgtcctgtggtaatgtcaaggtcaatgccatctatggtctgatggttgccctcctgatttggggctttgacatactgtgtatcaccaactcctataccatgattctccgggcagtggtcagcctctcctcagcagatgctcggcagaaggcctttaatacctgcactgcccacatttgtgccattgttttctcctatactccagctttcttctccttcttttcccaccgctttggggaacacataatccccccttcttgccacatcattgtagccaatatttatctgctcctaccacccactatgaaccctattgtctatggggtgaaaaccaaacagatacgagactgtgtcataaggatcctttcaggttctaaggataccaaatcctacagcatgtgaatgaacacttgccaggagtgaga

SEQ ID NO: 4623 - DNA, 1034 bp, Homo sapiens
ttctcttcaggatgaaacttctggaaaaatagaatgcctctatttaattcattatgctggtttccaacaattcatgtgactcctccatcttttattcttaatggaatacctggtctggaaagagtacatgtatggatctccctcccactctgcacaatgtacatcatcttccttgtggggaatcttggtcttgtgtacctcatttattatgaggagtccttacatcatccgatgtattttttttttggccatgctctctccctcattgacctccttacctgcaccaccactctacccaatgcactctgcatcttctggttcagtctcaaagaaattaacttcaatgcttgcttggcccagatgttctttgttcatgggttcacaggtgtggagtctggggtgctcatgctcatggctctagaccgctatgtagccatttgctaccctttgcgttatgctaccacactcaccaaccctatcattgccaaggctgagcttgccaccttcctgaggggtgtattgctgatgattcctttcccattcttggttaagcgtttgcctttctgccaaagcaatattatctcccatacgtactgcgaccacatgtctgtagtaaagctatcttgtgccagcatcaaggtcaatgtaatctatggtctaatggttgctctcctgattggagtgtttgacatttgttgtatatctttgtcttacactttgatcctcaaggcagcgatcagcctctcttcatcagatgctcggcagaaggctttcagcacctgcactgcccatatatctgccatcatcatcacctatgttccagcattcttcactttctttgcccaccgttttgggggacacacaattcccccttctcttcacatcattgtggctaatctttatcttcttcttcccccaactctaaaccctattgtttatggagtaaagacaaaacagatacgcaagagtgtcataaagttcttccagggtgataagggtgcaggttgattcaaggcaacttaattcagatggaa

SEQ ID NO: 4624 - DNA, 948 bp, Homo sapiens
atggtgctggcttcagggaacagctcttctcatcctgtgtccttcatcctgcttggaatcccaggcctggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctatctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggaatgggctctttgtggccttctctgtggctggctttgatatgattgtcattggtatgtcatacgtgatgattttgagagctgtgcttcagttgccctcaggtgaagcccgcctcaaagcttttagcacacgttcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctga

SEQ ID NO: 4625 - DNA, 1185 bp, Homo sapiens
atgttctaccccattttgaatgacataagtacgaaaaacaacagtaacatcatgtcatgttgtaacatattatttattaaaacagttgaaattattctagtttataatcaaacccaatcaccctggtatccaatagtcccatccaaaagccttgtatataataataacacttgttttgattgttatcatctgcagagagtagattgcgttcccagcagagaccatattaaccagtccatggtgctggcttcagggaacagctcttctcatcctgtgtccttcatcctgcttggaatcccaggcctggagagtttccagttgtggattgcctttccgttctgtgccacgtatgctgtggctgttgttggaaatatcactctcctccatgtaatcagaattgaccacaccctgcatgagcccatgtacctctttctggccatgctggccatcactgacctggtcctctcctcctccactcaacctaagatgttggccatattctggtttcatgctcatgagattcagtaccatgcctgcctcatccaggtgttcttcatccatgccttttcttctgtggagtctggggtgctcatggctatggccctggactgctacgtggctatctgcttcccactccgacactctagcatcctgaccccatcggtcgtgatcaaactggggaccatcgtgatgctgagagggctgctgtgggtgagccccttctgcttcatggtgtctaggatgcccttctgccaacaccaagccattccccagtcatactgtgagcacatggctgtgctgaagttggtgtgtgctgatacaagcataagtcgtgggaatgggctctttgtggccttctctgtggctggctttgatatgattgtcattggtatgtcatacgtgatgattttgagagctgtgcttcagttgccctcaggtgaagcccgcctcaaagcttttagcacacgttcctcccatatctgtgtcatcttggctctttatatcccagcccttttttctttcctcacctaccgctttggccatgatgtgccccgagttgtacacatcctgtttgctaatctctatctactgatacctcccatgctcaaccccatcatttatggagttagaaccaaacagatcggggacagggttatccaaggatgttgtggaaacatcccctga

SEQ ID NO: 4626 - DNA, 1114 bp, Homo sapiens
gacccccaaaatctctccccttatcttccctgtcaggagtcatgcccccatgagccctcaagttgtgcccaccacagaatggcagaaactctacaactcaattccaccttcctacacccaaacttcttcatactgactggctttccagggctaggaagtgcccagacttggctgacactggtctttgggcccatttatctgctggccctgctgggcaatggagcactgccggcagtggtgtggatagactccacactgcaccagcccatgtttctactgttggccatcctggcagccacagacctgggcttagccacatctatagccccagggttgctggctgtgctgtggcttgggccccgatctgtgccatatgctgtgtgcctggtccagatgttctttgtacatgcactgactgccatggaatcaggtgtgcttttggccatggcctgtgatcgtgctgcggcaatagggcgtccactgcactaccctgtcctggtcaccaaagcctgtgtgggttatgcagccttggccctggcactgaaagctgtggctattgttgtacctttcccactgctggtggcaaagtttgagcacttccaagccaagaccataggccatacctattgtgcacacatggcagtggtagaactggtggtgggtaacacacaggccaccaacttatatggtctggcactttcactggccatctcaggtatggatattctgggtatcactggctcctatggactcattgcccatgctgtgctgcagctacctacccgggaggcccatgccaaggcctttggtacatgtagttctcacatctgtgtcattctggccttctacatacctggtctcttctcctacctcacacaccgctttggtcatcacactgtcccaaagcctgtgcacatccttctctccaacatctacttgctgctgccacctgccctcaaccccctcatctatggggcccgcaccaagcagatcagagaccgactcctggaaaccttcacattcagaaaaagcccgttgtaatgtccagtggtaacaatggagcctaagagtggaggtgaggggacaatcggaggggagtctgggggtgtggatc

SEQ ID NO: 4627 - DNA, 1071 bp, Homo sapiens
tgcccataaacatagtcatcagaagcctactcagctcatgattcagcctatggcgtcacccagcaacagctccactgtcccagtctctgaattcctcctcatctgcttccccaacttccagagttggcagcactggctctccctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtatgatcttaggtcgatcagcttccctgcctgcttcctccagatgttcatcatgaacagtttcctccccatggagtcctgcacgtttatggtcatggcctatgaccgttatgtggccatctgccacccactgcggtacccatccatcatcactaatcaatttgtggccaaagctagtgtcttcattgtggtgcggaatgcgcttcttactgcacccattcctatcctcacttccctgctccattactgtggggaaaatgtcattgagaactgcatctgtgccaacttgtctgtgtccaggctctcctgtgataatttcacccttaacagaatctaccaatttgtggctggttggaccttgctgggctcagatttattcctcatcttcctctcttacaccttcattctaagagctgtgcttagattcaaagcagagggggcggcagtgaaggccctgagcacatgtggctcccacttcatcctcattcttttcttcagcaccatactgctggttgtggtgttgacaaacgtggccagaaagaaggtccccatggacatcctgatcctgctgaacgtccttcatcaccttattcctcctgcattgaaccctattgtgtatggggttcggaccaaagagataaaacagggaattcagaagttactgcagagagggaggtgaatatgtaaagcatttctaatacctcctgttcttcctcttcagtgattttacctaggcagcgaagtagagaaatgtca

SEQ ID NO: 4628 - DNA, 1022 bp, Homo sapiens
ggaaaatatgacaacacaccgaaatgacaccctctccactgaagcttcagacttcctcttgaattgttttgtcagatcccccagctggcagcactggctgtccctgcccctcagcctccttttcctcttggccgtaggggccaacaccaccctcctgatgaccatctggctggaggcctctctgcaccagcccctgtactacctgctcagcctcctctccctgctggacatcgtgctctgcctcactgtcatccccaaggtcctgaccatcttctggtttgacctcaggcccatcagcttccctgcctgcttcctccagatgtacatcatgaattgtttcctagccatggagtcttgcacattcatggtcatggcctatgatcgttatgtagccatctgccacccactgagatatccatcaatcatcactgatcactttgtagtcaaggctgccatgtttattttgaccagaaatgtgcttatgactctgcccatccccatcctttcagcacaactccgttattgtggaagaaatgtcattgagaactgcatctgtgccaatatgtctgtttccagactctcctgcgatgatgtcaccatcaatcacctttaccaatttgctggaggctggactctgctaggatctgacctcatccttatcttcctctcctacaccttcattctgcgagctgtgctgagactcaaggcagagggtgccgtggcaaaggccctaagcacatgtggctcccacttcatgctcatcctcttcttcagcaccatccttctggtttttgtcctcacacatgtggctaagaagaaagtctcccctgatgtgccagtcttgctcaatgttctccaccatgtcattcctgcagcccttaaccccatcatttacggggtgagaacccaagaaattaagcagggaatgcagaggttgttgaagaaagggtgctaacaaggaccactggatctctgaatatctaaaataagataatttattaatcacttaatgagtgagtggg

SEQ ID NO: 4629 - DNA, 1209 bp, Homo sapiens
cattgtggctggcatatgatacatacttggttaaatataagggaggatgatgacagtgattttaaaaactttattgggacagatacagggcctcagtggaaacccacactctactacgtctagaatgtactttttatgtttctgtacttctctactacgttttaaggtacactgggtctccagattgatcaggaaactttacatggcatctcccagcaatgactccactgccccagtctctgaattcctcctcatctgcttccccaacttccagagctggcagcactggttgtctctgcccctcagccttctcttcctcctggccatgggagctaacaccaccctcctgatcaccatccagctggaggcctctctgcaccagcccctgtactacctgctcagcctcctctccctgctggacatcgtgctctgcctcaccgtcatccccaaggtcctggccatcttctggtttgacctcaggtcgatcagcttcccagcctgcttcctccagatgttcatcatgaacagttttttgaccatggagtcctgcacgttcatggtcatggcctatgaccgttatgtggccatctgccatccattgagatacccgtctatcatcactgaccagtttgtggctagggccgtggtctttgttatagcccggaatgcctttgtttctcttcctgttcccatgctttctgccaggctcagatactgtgcaggaaacataatcaagaactgcatctgcagtaacctgtctgtgtccaaactctcttgtgatgacatcactttcaatcagctctaccagtttgtggcaggctggactctgttgggctctgatcttatccttattgttatctcctattcttttatattgaaagttgtgcttaggatcaaggccgagggtgctgtggccaaggccttgagcacgtgtggttcccacttcatcctcatcctcttcttcagcacagtcctgctggttctggtcatcactaacctggccaggaagagaattcctccagatgtccccatcctgctcaacatcctgcaccacctcattcccccagctctgaaccccattgtttatggtgtgagaaccaaggagatcaagcagggaatccaaaacctgctgaagaggttgtaagaataaaaaggattagatccacctttagagttgttaattgttagtgaaaattgggaaatagggaa

SEQ ID NO: 4630 - DNA, 1088 bp, Homo sapiens
tgtggtggttccaacctgtgataactgagaacaatacaaatagagatttgaaattcatgttgaatcatgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaaccttggggtcacaagcctggcttgtgatgacaggaggccaaacagcatttgccagttggttctggcatggcttggaatggggagtgatctaagtcttattatactgtcatatattttgattctgtactctgtacttagactgaactcagctgaagctgcagccaaggccctgagcacttgtagttcacatctcaccctcatccttttcttttacactattgttgtagtgatttcagtgactcatctgacagagatgaaggctactttgattccagttctacttaatgtgttgcacaacatcatccccccttccctcaaccctacagtttatgcacttcagaccaaagaacttagggcagccttccaaaaggtgctgtttgcccttacaaaagaaataagatcttagagaccttctccatgatgtacatgaacctcagcttctcctaaactgga

SEQ ID NO: 4631 - DNA, 1152 bp, Homo sapiens
acaggcatgaaccacgatgctcagccccttagctgaacttttaaacagagatttcttctatttcagacagacactgagactgaggcacccattccatggatacctccaccagtgttacctatgactccagcctccagatttcccagttcatcctgatgggattaccaggcattcatgagtggcagcactggctctccctgcccctgactctgctctacctcttagctcttggtgccaatctcctcatcataatcaccattcaacatgagaccgtgctacatgaacccatgtaccatttgctgggcatattagcagtggtggacattggcctggccaccaccatcatgcccaagatcctggccatcttctggtttgatgccaaggccattagcctccccatgtgttttgctcagatctatgccatccactgcttcttctgcatagagtcaggcatctttctctgcatggcagtagacagatacatagccatctgtcgccctcttcagtacccctccatagtcactaaagcttttgtcttcaaagccacagggttcatcatgctcaggaatggcctgttgaccatcccagtgcctatactggctgcccagagacactactgttccaggaatgaaatcgagcactgcctctgctctaacttgggggttatcagcctggcttgtgatgacatcactgtgaacaaattttaccaactgatgctagcatgggtcttggttgggagtgatatggctctggtattttcttcctatgctgtaatccttcactctgtgctgaggctgaactcagcagaagcaatgtccaaggctctgagcacttgtagctcccacctcatcctcatcctcttccacacaggtatcattgtgctgtctgtcacacaccttgcagagaaaaagattccccttattcctgtgttccttaatgtgctgcacaatgtcatcccccctgcactcaaccccctggcctgtgcactcaggatgcacaaactcagactgggctttcagagactgcttggactgggtcaggacgtgtccaagtaactccagctttaggaatccagtaagatgttaggaaatgacagaggttttagttctcaatagatcagggttataatctgcacttaccacactccctagg

SEQ ID NO: 4632 - DNA, 1373 bp, Homo sapiens
atgtttgccttagctcatttccagattaaagaagagagcagtggcctcagctcagtgattaattacatgaactccttacgtggtattcgaccaatataagcccattaagagaaaggctgggttcttgttgtggcctactgaagactctctactctcatctcctgaagagcagtaagagagaccaatgacatggagtggcggaaccatagtgggagagtgagtgagtttgtgttgctgggcttccctgctcctgcgccactacaggtactattgtttgcccttttgctgctggcctatgtgttggtgctgactgagaacacactcatcattatggcaattaggaaccattctaccctccacaaacccatgtacttttttctagctaatatgtcctttctggagatctggtatgtcactgtcactattcccaagatgcttgctggctttgttggatccaaacaggatcatggacagctaatctcctttgagggatgcatgacacagctctactttttccttggcttgggctgcactgagtgtgtccttctcgctgttatggcctatgatcgctatatggccatctgctatcctctccactacccagtcattgtcagtggccggctgtgtgtgcagatggctgctggctcttgggctggaggttttggcatctccatggtcaaagtttttcttatttctggcctctcttactgtggccccaacatcatcaaccactttttctgtgatgtctctccattgctcaacctctcatgcactgatatgtccacagcagagcttacagatttcatcctggccatttttattcttctagggccactctctgtcactggggcctcctatgtggccattactggtgctgtgatgcacattccttcggctgctggacgctataaggccttttccacctgtgcctctcatctcactgttgtgataatcttctatgcagccagtatcttcatctatgctcggccaaaggcactctcagcttttgacaccaacaagttggtctctgtactgtatgctgtcattgtaccattgctcaatcccatcatttactgcctgcgcaatcaagaggtcaagagagccctatgctgtactctgcacctgtaccagcaccaggatcctgaccccaagaaagctagcagaaatgtatagaagggatgtgtgaaatctgataaaatgctattaaacttgggatcaatgtgttctatgaagtccagtggagttcttagggcctaaattgggggccagagtttcaaaggcatcactatggaactaggaatactttctttaactagtccaagaggagagagaggaataggttgcaagctagaaaatggatttctgcaggacag

SEQ ID NO: 4633 - DNA, 1047 bp, Homo sapiens
tagctgggccatggagtctgatcaaatgatttttcctccccaggagagctaagccctgtgtctccaatatggagttggagaaccagacacgagtcaccaagttcattctggtgggattccctgggagcttgagtatgcgggcagccatgtttctgatattccttgtggcctatattctgacagtggctgaaaacgtgatcatcatcctattggtgctgcaaaatcggccactgcacaagcctatgtacttcttcctggccaacctgtccttcttggagacctggtacatctctgtgactgtgcccaagttactgtttagtttttggtctgtgaacaacagcatctctttcacactctgtatgatacaactgtacttcttcattgctctcatgtgcacagaatgtgtgcttctggccgccatggcctatgaccggtatgtggccatctgtcgcccactccactacccaaccataatgagccatgggctctgcttccgcctcgctcttggttcctgggccattggctttggcatctccctggcgaagatctacttcatctcctgcctcagcttctgtggtcccaatgtcatcaaccacttcttctgtgacatctctccagtacttaatctctcctgcacagacatgtccataactgagttggtagactttatcctggcactggtcatcttcctattcccactctttattactgtcctgtcctacggatgcattctggccaccatattatgcatgcccacaggaaagcagaaagcgttctccacttgtgcctcccatcttgtggtggtcaccattttctattcagccattattttcatgtatgctcgacctcgagttatccatgccttcaacatgaacaaaattatttccatcttctatgccattgtcactccttctctcaaccctttcatttattgcctaagaaaccgagaggtcaaggaagctctgaagaaactggcatattgccaggccagcagatctgactagtcaattacagctgattagaaagaaaggtctgagtgggtgcctg

SEQ ID NO: 4634 - DNA, 1066 bp, Homo sapiens
gcagccctttcctcttgctctttgatgttttgtaggcctgcagctcccaagcacagaggcatgagtggggagaatgtcaccaaggtcagcaccttcatcctggtgggcctccccacggccccagggctgcagtacctgctcttcctcctcttcctgctcacctacctctttgtcctggtggagaacctggccatcatcctcatcgtctggagcagcacctccctccacaggcccatgtactactttctgagctccatgtctttcctggagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcatcctggccttcatcatcctggtgtttccgctcctggccaccatactgtcatattggcacatcaccctggctgtcctgcgcatcccctcggccaccggctgctggagagccttctctacctgcgcctctcacctcaccgtggtcaccgtcttctatacagccttgcttttcatgtatgtccggccccaagccattgattcccagagctccaacaagctcatctctgccgtgtacactgttgtcacgccaataattaaccctttgatttactgcctgaggaacaaggaatttaaggacgccttgaaaaaggccttgggcttgggtcaaacttcacactaagacaactaaatgtcctagagtaaaatctgtagtgatgaaacaacattgtatgtggcactttgtgctc

SEQ ID NO: 4635 - DNA, 996 bp, Homo sapiens
atgagtggggagaatgtcaccagggtcggcaccttcatcctggtgggcttccccacggccccagggctgcagtacctgctcttcctcctcttcctgctcacctacctctttgtcctggtggagaacctggccatcatcctcaccgtctggagcagcacctccctccacaggcccatgtactactttctgagctccatgtctttcctagagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcattctggccttcatcatcctggtgtttccactcctggccaccatgctgtcatatgcgcacatcaccctggctgtcctgcgcatcccctcggccaccggctgctggagagccttcttcacctgcgcctctcacctcaccgtggtcaccgtcttctatacagccttgcttttcatgtatgtccggccccaggccattgattcccggagctccaacaagctcatctctgttttgtacacagttatcacccccatcttgaaccccttgatatactgcctgaggaataaggaatttaagaatgccttgaaaaaagccttcggcttgacgagctgcgccgtagaggggaggctttctagtcttctggaacttcatctccaaatacacagccagcctctctga

SEQ ID NO: 4636 - DNA, 1063 bp, Homo sapiens
tgtaggtctggcaggggaaaaaagaaagcaactgaagaatgagaaaccatacagaaataacagagtttattcttctgggattaacagatgacccaaattttcaggttgtaatctttgtcttcctgctcatcacctacatgctcagcatcactgggaacctgacccttatcacaattaccctgctggattcccacctgcagacccccatgtatttcttcctcagaaatttctccatattagaaatttcgttcacaaccgtcagtatacccaagtttctgggtaacattatttcaggagataaaaccatttcctttaataattgcatagttcagttatttttcttcattctcttgggagtcacagagttttaccttctggctgccatgtcctatgaccgctatgtggccatctgcaagcctctgcattgcttgagtatcatgaatcgaagagtctgcacactgcttgtttttacttcttggctggtttcattcttaatcatattcccagcactcatgttgcttttaaagcttcattactgtaggtctaatattattgaccattttacctgtgattattttccactgctgcaacttgcttgttcagacacaaaattcttagaggtgatgggattttcttgtgctgcgtttactctaatgttcactttggcattaatatttctgtcctacatatacattatcagaacaattttgagaattccttctactagtcagaggacaaaggccttttccacatgttcttcccacatggttgttgtctccatctcttatggcagctgcatttttatgtacattaaaccctcagcaaaagatagagtgtccttgagcaagggagtggcaatactaaacacctcagtagcccccatgatgaacccctttatttacagcctaagaaatcagcaagtcaagcaagctttcattaacatggcaaggaagactgtatttttcacaagcacatgaaatggtatggtgtgatgaattagaggcacaggaaaggacaatatgaattttcagtagcttcttcaatcaaaatggcctccttgcag

SEQ ID NO: 4637 - DNA, 939 bp, Homo sapiens
atgaaaaaccacacagtaataagaacttttatcctgctgggactgacaggtgacccacacctgcaagttctgctttttatctttctatttctcacctacatgttgagtgtaacagggaacctgactattatcaccctcacattggtggaccaccaccttaaaactcctatgtacttctttctcagaaatttttccttcttagaagtctcatttactacagtctgcattcccagattcttgtacaatatatcaatgggggacaataccattacctacaatgcttgtgccagtcaaatattctttgttattctctttggagcaacagaattttttctcttggcagccatgtcctatgaccgctatgtggccatctgtaaaccccttcattatgtggtcatcatgaacaacagggtgtgtaccttattagttctctgctgttgggtggctggcttgatgatcattgttccaccacttagcttaggcctccagctcgaattctgtgactccaatgccattgatcattttagctgtgatgcaggtcctctcctaaagatctcatgctcagatacatgggtaatagaacagatggttatacttatggctgtatttgcactcattatcaccctagtttgtgtgattctgtcctacttgtacatagtcagaacaattctgaagttcccttctgttcagcaaaggaaaaaggccttttctacctgttcatcccacatgattgtggtttccattgcctatggaagctgcatcttcatctatatcaagccctctgcaaaagatgaggtggccataaataaaggagtttcagttcttactacttctgtcgcacccttgttgaaccccttcatttacaccttgaggaacaagcaagtgaaacaagctttcagtgactctataaagaggattgcatttctctcaaagaagtag

SEQ ID NO: 4638 - DNA, 936 bp, Homo sapiens
atgaaccacacaatggtcacagagtttgtcctcctgggcctttctgatgatcctgaccttcagattgtgatttttctctttttatttatcacgtatatattaagtgttactggaaacctgactatcatcaccctaacctttgtggactcccatctgcagacacctatgtatttcttcctccggaacttctctttcttagaaatctcatttacaaccgtatgcatccccagatttctgggggcaattatcaccaggaataagactatttcctataacaactgtgcagcccaactctttttctttatcttcatgggggtgactgaattttacattttaactgccatgtcctatgaccgctatgttgccatctgcaagccccttcattacacatccatcatgaacaggaaactctgcactctacttgtgctgtgtgcctggctaagtgggtttctgaccattttcccaccccttatgcttctcctccagctggattactgtgcttccaacgtcattgatcactttgcatgtgactattttcccctcttacaactatcttgttcagatacatggctcctagaagtaattggtttttactttgctttggttactttgctgttcactttggcattagtgattttatcttacatgtacattatcaggaccattttgagaatcccgtctgccagtcaaagaaaaaaggctttctccacttgttcttctcacatgattgtcatttccatttcttatggaagctgtatattcatgtatgctaatccatctgcaaaagaaaaggcatcattgacaaaaggaatagctattctcaatacatctgttgcccccatgctgaaccccttcatttacactctgagaaaccagcaagtaaaacaagccttcaaaaatgtggtccacaaagttgtgttttatgcaaatcaatga

SEQ ID NO: 4639 - DNA, 1046 bp, Homo sapiens
ttgcctttaggttttccgaaggtcaacaatgaaaaacagaaccatgtttggtgagtttattctactgggccttacaaatcaacctgaactccaagtgatgatattcatctttctgttcctcacctacatgctaagtatcctaggaaatctgactattatcaccctcaccttactagacccccacctccagacccccatgtatttcttcctccggaatttctccttcttagaaatttccttcacatccatttttattcccagatttctgaccagcatgacaacaggaaataaagttatcagctttgctggctgcttgactcagtatttttttgctatatttcttggagctaccgagttttacctcctggcctccatgtcttatgatcgttatgtggccatctgcaaacccttgcattacctgactattatgagcagcagagtctgcatacaactagtgttctgctcctggttggggggattcctagcaatcttaccaccaatcatcctgatgacccaggtagatttctgtgtctccaacattctgaatcactattactgtgactatgggcctctcgtggagcttgcctgctcagacacaagcctcttagaactgatggtcatcctcttggccgttgtgactctcatggttactctggtgctggtgacactttcttacacatacattatcaggactattctgaggatcccttctgcccagcaaaggacaaaggccttttccacttgttcctcccacatgattgtcatctccctctcttatggcagctgcatgtttatgtacattaatccttctgcaaaagaaggaggtgctttcaacaaaggaatagctgtactcattacttcggttactcccttactgaatcccttcatatatactttaagaaatcagcaagtgaaacaagctttcaaggactcagtcaaaaagattgtgaaactttaaaaaaggagattacacttcaaaatacattttcacttaacaaatatgcattgaatgtctatatttcaagtgctaaattggcccttgaaga

SEQ ID NO: 4640 - DNA, 1076 bp, Homo sapiens
tgcagaataagagcaatcctagtgtatttgaaatcaaatcacgtattgacattcactcttctttttatctacagacctatcagaattcagaactaagccatgccaaatatgacatcaattagagaattcattcttctgggatttacagataacccagagttacaagttgtgatattcttctttatgttgatcacatacttattgagtgtaagtggaaacatgatcatcattatgttaacattgtcaaatattcatttgaaaactcctatgtatttcttcctcaggaatttctctttcttagaaatttcatttacgacagtcttcattcctagatttctgatcaacattgctacaggagacacaaccatttcctataatgcttccatggcccaagtattttttttaattcttttgggatcaacagaattttttcttctggctgtcatgtcttatgatcgctatgtggctatctgcaaacctctacattatacaaccatcatgagtaacaaagtctgtaattggcttgtaatcagctcctggctggctggttttctcattatttttccccccgtgattatgggcctccaactggatttttgtgactccagcactattgaccatttcatctgtgattcttcccctatgctgctgattgcttgcacagacacacagtttctagagcttatggcatttttgctagcagtattcacactcatggtaactttggccttggtggttctctcctacacactcatccttaaaacaattctgaagattccctctgcccagcaaaggaaaaaggctttttcaacttgttcctcccatatgattgtggtttctgtttcttatgggagttgcatttttatgtgtgtaaaaacatctgcaaaagaaggtatggctttgagcaaaggtgtagcagtgcttaatacctctgttgctcctatgttgaatccctttatttataccttaagaaaccagcaggtgaaacaggcccttagggaattcaccaaaaaaatattatcattgaacaagcaataatgataactaaatctgtggctgaaacacaaataagccaa

SEQ ID NO: 4641 - DNA, 954 bp, Homo sapiens
atgcagaagtcagtaatgagaaaacacacagcaataacaacattcatccttctgggactgacagaagatcctcagctgcaggttctgcttttcatgtttctatttatcacctacatgttgagtgtaacagggaaactgaccattatcgccctcaccatgttggatccccacctgaaaacacccatgtatttttttctccaaaatttatctttcttagaaatctcatttacagctacctgtgttccaagattcttatacagtatctcaactgggaacaaaataataacgtataatgcatgtgtcattcagctattttttgcagacctctttggggtaactgaattttttcttttggctaccatgtcatatgatcgctatgtggccatctgcaaacccttgcattatatggcaatcatgagcaacaaagtgtgcaaaacaatggttatttgttgttggatggcagcacttatgattatcctcccaccacttagcttaggttttcatctagaattctgtgactctaatgtcatcaatcattttggctgtgatgcattgcctattctgaaaataccatgctcagacacatcattaattgagcagatggttgtagcctctgctgtattaacctttattatcactcttgtatgtgtagttctgtcctacacatatatcataagaacaattctaaaattcccttctgttcaacaaaagaaaaaagccttttctacctgttcttcacatattactgtggtttccatcacttatggcagctgcatcttcatctatatcaagccatctgcaaaagaagaggtaaacattaataaaggtgtgtcagtgcttatttcatccatatcacctatgttgaattctttcatatatactcttaggaatgagcaagttaaacaagcctttcatgactcactcaaaaaaattgcatttcgtttaaaaaagtaa

SEQ ID NO: 4642 - DNA, 939 bp, Homo sapiens
atgagaaaacacacagcaataacaacattcatccttctgggactgacagaagatcctcagctgcaggttctgcttttcatgtttctatttatcacctacatgttgagtgtaacagggaaactgaccattatcgccctcaccatgttggatccccacctgaaaacacccatgtatttttttctccaaaatttatctttcttagaaatctcatttacagctacctgtgttccaagattcttatacagtatctcaactgggaacaaaataataacgtataatgcatgtgtcattcagctattttttgcagacctctttggggtaactgaattttttcttttggctaccatgtcatatgatcgctatgtggccatctgcaaacccttgcattatatggcaatcatgagcaacaaagtgtgcaaaacaatggttatttgttgttggatggcagcacttatgattatcctcccaccacttagcttaggttttcatctagaattctgtgactctaatgtcatcaatcattttggctgtgatgcattgcctattctgaaaataccatgctcagacacatcattaattgagcagatggttgtagcctctgctgtattaacctttattatcactcttgtatgtgtagttctgtcctacacatatatcataagaacaattctaaaattcccttctgttcaacaaaagaaaaaagccttttctacctgttcttcacatattactgtggtttccatcacttatggcagctgcatcttcatctatatcaagccatctgcaaaagaagaggtaaacattaataaaggtgtgtcagtgcttatttcatccatatcacctatgttgaattctttcatatatactcttaggaatgagcaagttaaacaagcctttcatgactcactcaaaaaaattgcatttcgtttaaaaaagtaa

SEQ ID NO: 4643 - DNA, 939 bp, Homo sapiens
atgaagaatcatacaaggcagatagaatttattcttctgggactgacggataattctcagttacagattgtaattttcttatttctacttctaaattgtgtgttgagcatgatagggaacttcactatcattgccctcattctgctggattcccagctcaagactccaatgtatttcttcctccgtaatttctcttttctggaaatttcattcacaactgcttgcattcccagattcctaatcaccattgttaccagggaaaagaccatttcctgtaatggttgcatatctcagttgtttttttacatattcttgggggttacagaatttttccttctagctgctctgtcctatgatcgctatgttgccatctgcaaacctttgcgttatatgtccatcatgagtaacaaagtttgctaccagcttgtattcagttcttgggtaactggattcctgatcattttcactccactgattttaggtcttaacttggatttctgtgcttcaaatatcattgatcatttcatttgtgacatttctcttatcctacaactttcttgctcagacacacatttactggaactgattgcctttttattagctgtgatgacacttattgtcacattgtttttagtaatcctttcttactcttacatcatcaagacaattctgaaattcccttcagctcagcaaaagaagaaagccttttccacctgctcttctcacatgattgttgtctccatcacttatggtagttgtatgtttatctacataaagccatcagcgaatgaaagagttgctttaagcaaaggagtaactgtgctcaatacttcagttgccccgttgttaaacccatttatttatactctgaggaatcagcaagttaaacaagccttcaaagctgtatttagaaagatattttctgcttcagacaagtaa

SEQ ID NO: 4644 - DNA, 1105 bp, Homo sapiens
tggtggatttcaagaaaaatgggtatctcatgcagacctttcctcttctgttctaatttttcttcttatttttaaaaatagaaatcaactatgagaaaccatacaacagtagcaaactttattcttcttggactgacagatgatccacaattacaggtgattatttttcttctcctttttttcacctacatgttgagcatcactgggaatctaaccatcatcactctcaccctactggatttgcatctcaagacacccatgtatttcttcctccgaaatttctcatttttagaagtctcattcacaactgtctacattcccaaatttcttgttagtatggcaacaggtgataagaccatttcttacaacgattgtgcagcacagctgtttttcactattctcttgggggcaactgaattttttcttctggctgccatgtcctatgagcgctatgtggccatctgcaaacccctgcattacaccaccatcatgagcagcagagtttgcagcttgctggtctttgcttcatggatggctggcttcctaataatttttccgccactcctgatgggtctccagcttgatttctgtgcagccaacactgtagatcatttcttctgtgatgtttctcctatactgcagctctcttgcacagacactgacataatagaattaatgatgcttctctcagccattttgacgctcctggttacactggtattagtgattctctcctacacaaatattatcaggactattctgaaaataccttcttctcaacagagaaaaaaagcattttctacatgttcttcccacatggtggtcgtgtccatttcttatggcagctgcatcttcatgtatgtgaaaccctcagcaaaagaaagagtgtcattaaataaagggatagctctgctcagcacttctgttgcccccatgttgaatccctttatttatacactgagaaacaaacaagtaaaagatgtttttaagcacacagtcaaaaagattgaacttttctcaatgaaatgaatcactttaacgatattattaaggttattagtaaaataaaacaagaagagtggagtatgtgcaaagtttttcaatg

SEQ ID NO: 4645 - DNA, 939 bp, Homo sapiens
atgagaaattccacagcagtaacagactttattcttcttggattgacaagtgacccacagtggcaggttgtacttttcatatttcttcttgttacctacatgttaagtgtgactgggaacctgatcattatcaccctcaccctttcagatccccatctgcagactcccatgtatttcttccttcggaacttctcattcctggaaatttcattcacgtctgtctgcattcccagattccttgtcactgttgtgacaggaaacagaaccatttcttataatgggtgtgtggctcagctattttttttcatcttcttgggggtgacagaattttaccttctggctgccatgtcctatgaccgctgcatggccatctgcaaacctcttcattacacaatcatcatgagcaccagagtgtgtacccttcttgtctttagctcctggcttgcagggtttctgatcatctttccaccagtaatgcttctgctgcagttggatttctgtgcctccaatgtaattgatcattttatctgtgactcttctccaatgctgcagctctcttgcacaaacactcactttctagaactcatggcattttttttagctgtggtaacactgatggtcaccttgacattagttattctctcctacacaaacatcatccggacaattctgaaaattccttctatgagtcaaaggaaaaaagccttttccacttgctcctcccatatgatagttgtctccatctcttacagtagctgtatcttcatgtacattaagacttctgccagagaaagggtgactttaagcaaaggagtagctgtgctcaatacctcagtggctcctctcttgaatcccttcatatacacactgagaaataagcaagtgaagcaagccttcaagagcatggtccagaagatgattttttctttaaataaatga

SEQ ID NO: 4646 - DNA, 1061 bp, Homo sapiens
gttaaagggctcagtgcggggactctgttttctggtttcagtaccacaatggacacaggcaacaaaactctgccccaggactttctcttactgggctttcctggttctcaaactcttcagctctctctctttatgctttttctggtgatgtacatcctcacagttagtggtaatgtggctatcttgatgttggtgagcacctcccatcagttgcatacccccatgtacttctttctgagcaacctctccttcctggagatttggtataccacagcagcagtgcccaaagcactggccatcctactggggagaagtcagaccatatcatttacaagctgtcttttgcagatgtactttgttttctcattaggctgcacagagtacttcctcctggcagccatggcttatgaccgctgtcttgccatctgctatcctttacactacggagccatcatgagtagcctgctctcagcgcagctggccctgggctcctgggtgtgtggtttcgtggccattgcagtgcccacagccctcatcagtggcctgtccttctgtggcccccgtgccatcaaccacttcttctgtgacattgcaccctggattgccctggcctgcaccaacacacaggcagtagagcttgtggcctttgtgattgctgttgtggttatcctgagttcatgcctcatcacctttgtctcctatgtgtacatcatcagcaccatcctcaggatcccctctgccagtggccggagcaaagccttctccacgtgctcctcgcatctcaccgtggtgctcatttggtatgggtccacagttttccttcacgtccgcacctctatcaaagatgccttggatctgatcaaagctgtccacgtcctgaacactgtggtgactccagttttaaaccccttcatctatacgcttcgtaataaggaagtaagagagactctgctgaagaaatggaagggaaaataaatctcctctaccacaacagatgtcctgtaaatggtctctgcatctatacagaggttccaagtaagaatgtggaggaatagggcaaa

SEQ ID NO: 4647 - DNA, 1044 bp, Homo sapiens
atgggtaactggactgcagcggtgactgagtttgttctgctggggttttccctgagcagggaggtggagctgctgctcctggtgctcctgctgcccacgttcctgctgactcttctggggaacctgctcatcatctccactgtgctgtcctgctcccgcctccacacccccatgtacttcttcttgtgcaacctctctatcctggacatcctcttcacctcagtcatctctccaaaagtgttggccaacttaggatctagggataaaaccatctcctttgccggatgtatcacccagtgctatttctactttttcttgggcacagttgagttcctcctgctgacggtcatgtcctatgaccgttatgccaccatctgctgccccctgcggtacaccaccatcatgagaccttctgtctgcattgggaccgttgtattctcttgggtgggaggcttcctgtctgtgctctttccaaccatcctcatctcccagctgcccttctgtggctccaatatcattaaccacttcttctgtgacagtggacccttgctggccctggcctgtgcagacaccactgccatcgagctgatggattttatgctttcttccatggtcatcctctgctgcatagtcctcgtggcctattcctatacgtacatcatcttgaccatagtgcgcattccttctgcaagtggaaggaagaaggcctttaatacctgtgcttcccacctgaccatagtcatcattcctagtggcatcactgtgtttatctatgtgactccctcccagaaagaatatctggagatcaacaagatccctttggttctgagcagtgtggtgactccattcctcaacccctttatatatactctgaggaatgacacagtgcagggagtcctcagggatgtgtgggtcagggttcgaggagtttttgaaaagaggatgagggcagtgctgagaagcagattatcctccaacaaagaccaccaaggaagggcttgctcttctccaccatgtgtctattctgtaaagctccagtgttag

SEQ ID NO: 4648 - DNA, 1118 bp, Homo sapiens
gcttgagtgcactggaaattgaaactctcactttcaacttggagatggagagccccaatcgaaccaccattcaggagtttatcttctccgctttcccttattcctgggttaagtctgttgtctgctttgttccactgctcttcatctatgctttcattgttgttggaaacctggtcatcatcacagtggtccagttgaatactcacctccacactcccatgtatacttttatcagtgctctttctttcctggagatttggtataccacagccacaatcccaaagatgctgtctagcctgcttagtgagaggagcatttccttcaatggttgtctcctgcagatgtatttcttccattccaccggcatctgtgaggtgtgtctcttgacagttatggcctttgaccactacctggccatatgcagccctcttcattatccctctatcatgacccccaagctatgtacccaactgactttaagttgctgtgtttgtggctttatcacaccccttcctgagattgcctggatctctacactgccattttgtggttcgaatcaccttgaacatatcttctgtgacttcctcccagtgctgcgtctggcctgcacagacacacgagccatcgtcatgattcaggtagtggatgtcattcatgcagtggagattattacagctgtgatgctcatcttcatgtcctacgatggtattgtggctgtaattctacgtattcattcagctggaggccgccgcacagcattttccacgtgtgtctctcacttcattgtcttttcgctcttctttggcagtgtgactctcatgtacctacgcttctctgccacctactctttgttctgggatatagccattgctctggcctttgcagttttgtctcccttcttcaaccccattatctatagcctgaggaataaagaaataaaagaagctataaaaaagcacataggtcaagctaagatatttttttccgtaagaccagggacctcaagtaagatattttagttgagattctgtatagttgctggttcctcttcaccttcagctctcagcaatctgtcttttcctatcaaccttctattcaaactggtctcccaaagctca

SEQ ID NO: 4649 - DNA, 948 bp, Homo sapiens
atggagagcggaaaccaatcaacagtgactgaatttatcttcactggattccctcagcttcaggatggtagtctcctgtacttctttcctttacttttcatctatacttttattatcattgataacttattaatcttctctgctgtaaggctggacacccatctccacaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcaactctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattccctcttctgaagggaggcaaaaggctttttctacctgtgcaggccacctcatggtcttcccgatattctttggcagtgtatcactcatgtacttgcgtttcagcgacacttatccaccagttttggacacagccattgcactgatgtttactgtacttgctccattcttcaatcccatcatttatagcctgagaaacaaggacatgaacaatgcgattaaaaaactgttctgtcttcaaaaagtgttgaacaagcctggaggttaa

SEQ ID NO: 4650 - DNA, 996 bp, Homo sapiens
atgtgctggactatgccctctccatttacaggtagctctactagaaatatggagagcggaaaccaatcaacagtgactgaatttatcttcactggattccctcagcttcaggatggtagtctcctgtacttctttcctttacttttcatctatacttttattatcattgataacttattaatcttctctgctgtaaggctggacacccatctccacaaccccatgtataattttatcagtatattttcctttctggagatctggtacaccacagccaccattcccaagatgctctccaacctcatcagtgaaaagaaggccatctcaatgactggctgcatcttgcagatgtatttcttccactcacttgaaaactcagaggggatcttgctgaccaccatggccattgacagatacgttgccatctgcaaccctcttcgctatcaaatgatcatgaccccccggctctgtgctcaactctctgcaggttcctgcctcttcggtttccttatcctgcttcccgagattgtgatgatttccacactgcctttctgtgggcccaaccaaatccatcagatcttctgtgacttggtccctgtgctaagcctggcctgtacagacacgtccatgattctgattgaggatgtgattcatgctgtgaccatcatcattaccttcctaatcattgccctgtcctatgtaagaattgtcactgtgatattgaggattccctcttctgaagggaggcaaaaggctttttctacctgtgcaggccacctcatggtcttcccgatattctttggcagtgtatcactcatgtacttgcgtttcagcgacacttatccaccagttttggacacagccattgcactgatgtttactgtacttgctccattcttcaatcccatcatttatagcctgagaaacaaggacatgaacaatgcgattaaaaaactgttctgtcttcaaaaagtgttgaacaagcctggaggttaa

SEQ ID NO: 4651 - DNA, 1172 bp, Homo sapiens
cagatgattttggcatggaggtaaagcttaagagatatttctaactggtttcttcaggattccagaatcagcttgagtaactcattacagaaaggaatgaagcaatattcagtgggtaatcaacattccaattataggagtctcttgtttccttttctgtgttcacagatgacacagttgacggccagtgggaatcagacaatggtgactgagttcctcttctctatgttcccgcatgcgcacagaggtggcctcttattctttattcccttgcttctcatctacggatttatcctaactggaaacctaataatgttcattgtcatccaggtgggcatggccctgcacacccctttgtatttctttatcagtgtcctctccttcctggagatctgctataccacaaccaccatccccaagatgctgtcctgcctaatcagtgagcagaagagcatttccgtggctggctgcctcctgcagatgtactttttccactcacttggtatcacagaaagctgtgtcctgacagcaatggccattgacaggtacatagctatctgcaatccactccgttacccaaccatcatgattcccaaactttgtatccagctgacagttggatcctgcttttgtggcttcctccttgtgcttcctgagattgcatggatttccaccttgcctttctgtggctccaaccagatccaccagatattctgtgatttcacacctgtgctgagcttggcctgcacagatacattcctagtggtcattgtggatgccatccatgcagcggaaattgtagcctccttcctggtcattgctctatcctacatccggattattatagtgattctgggaatgcactcagctgaaggtcatcacaaggccttttccacctgtgctgctcaccttgctgtgttcttgctattttttggcagtgtggctgtcatgtatttgagattctcagccacctactcagtgttttgggacacagcaattgctgtcacttttgttatccttgctccctttttcaaccccatcatctatagcctgaaaaacaaggacatgaaagaggctattggaaggcttttccactatcagaagagggctggttgggctgggaaatagatacagatcctggagactctaaaaagcctcttggaagagcaaaa

SEQ ID NO: 4652 - DNA, 1053 bp, Homo sapiens
ttcttcagggaaaccctgcccaccatatagtagttgtcatgggaaactggagcactgtgactgaaatcaccctaattgccttcccagctctcctggagattcgaatatctctcttcgtggttcttgtggtaacttacacattaacagcaacaggaaacatcaccatcatctccctgatatggattgatcatcgcctgcaaactccaatgtacttcttcctcagtaatttgtcctttctggatatcttatacaccactgtcattaccccaaagttgttggcctgcctcctaggagaagagaaaaccatatcttttgctggttgcatgatccaaacatatttctacttctttctggggacggtggagtttatcctcttggcggtgatgtcctttgaccgctacatggctatctgcgacccactgcactacacggtcatcatgaacagcagggcctgccttctgctggttctgggatgctgggtgggagccttcctgtctgtgttgtttccaaccattgtagtgacaaggctaccttactgtaggaaagaaattaatcatttcttctgtgacattgcccctcttcttcaggtggcctgtataaatactcacctcattgagaagataaactttctcctctctgcccttgtcatcctgagctccctggcattcactactgggtcctacgtgtacataatttctaccatcctgcgtatcccctccacccagggccgtcagaaagctttttctacctgtgcttctcacatcactgttgtctccattgcccacgggagcaacatctttgtgtatgtgagacccaatcagaactcctcactggattatgacaaggtggccgctgtcctcatcacagtggtgacccctctcctgaacccttttatctacagcttgaggaatgagaaggtacaggaagtgttgagagagacagtgaacagaatcatgaccttgatacaaaggaaaacttgacactggtatacactacattaaatacatttctttttttattattttttttaagttccagggtacatgtgcagga

SEQ ID NO: 4653 - DNA, 1027 bp, Homo sapiens
agggacatgaatggtgagcaatggacacagggaactggagccaggtagcagaattcatcatcttgggcttcccccatctccagggtgtccagatttatctcttcctcttgttgcttctcatttacctcatgactgtgttgggaaacctgctgatattcctggtggtctgcctggactcccggcttcacacacccatgtaccactttgtcagcattctctccttctcagagcttggctatacagctgccaccatccctaagatgctggcaaacttgctcagtgagaaaaagaccatttcattctctgggtgtctcctgcagatctatttctttcactcccttggagcgactgagtgctatctcctgacagctatggcctacgataggtatttagccatctgccggcccctccactacccaaccctcatgaccccaacactttgtgcagagattgccattggctgttggttgggaggcttggctgggccagtagttgaaatttccttgatttcacgcctcccattctgtggccccaatcgcattcagcacgtcttttgtgacttccctcctgtgctgagtttggcttgcactgatacgtctataaatgtcctagtagattttgttataaattcctgcaagatcctagccaccttcctgctgatcctctgctcctatgtgcagatcatctgcacagtgctcagaattccctcagctgccggcaagaggaaggccatctccacgtgtgcctcccacttcactgtggttctcatcttctatgggagcatcctttccatgtatgtgcagctgaagaagagctactcactggactatgaccaggccctggcagtggtctactcagtgctcacacccttcctcaaccccttcatctacagcttgcgcaacaaggagatcaaggaggctgtgaggaggcagctaaagagaattgggatattggcatgagttggggctgagagtaggccaaggccgggcctgaggatatggtggccccagggatcaacagtggccag

SEQ ID NO: 4654 - DNA, 954 bp, Homo sapiens
atggatcaatacaaccattcaagcctggctgaatttgtgttccttggctttgccagtgtgggctatgtcaggggctggctttttgtcctgctgctattggcatacctgttcaccatctgtggtaacatgctcatcttctcagtcatccgactggatgcagctctgcacacacctatgtaccactttgtcagtgttctttccttcttggagttgtggtatacagctaccactatccctaagatgttgtctaatattctcagtgagaagaaaaccatttcttttgcaggatgcctccttcagacctacttcttccactccttgggagcgtctgaatgctaccttcttacagccatggcctatgatagatacctggccatttgtcggcccctccactaccctataattatgaccaccacactctgtgccaagatggctgctgcttgttggacttgtggcttcctgtgtcccatttctgaggtcatccttgcctcccagctcccattttgtgcttacaatgaaatccaacacattttctgtgactttccacctttgctgagcttggcctgcaaggacacatctgctaacattctggtggactttgccattaatgctttcataattcttatcactttcttctttatcatgatttcttatgcaaggatcattggggctgtgctgaagataaaaacagcatcaggaagaaagaaggccttttctacctgtgcctcacatcttgctgtggtcctcatcttctttgggagcatcatcttcatgtatgtgcggctaaagaagagctattccctgacccttgaccgaacacttgctatagtttactccgtactaacaccaatggtcaatccaattatctacagtcttcgtaacaaggaaatcattaaagctatcaagaggaccatcttccagaagggagataaagctagtcttgctcatctttga

SEQ ID NO: 4655 - DNA, 954 bp, Homo sapiens
atgagaaatttgagtggaggccatgtcgaggagtttgtcttggtgggtttccctaccacgcctcccctccagctgctcctctttgtccttttttttgcaatttaccttctgacattgttggagaatgcacttattgtcttcacaatatggcttgctccaagccttcatcgtcccatgtactttttccttggccatctctctttcctggagctatggtacatcaatgtcaccattcctcggctcttggcagcctttcttacccaggatggtagagtctcctacgtaggttgcatgacccaactgtacttctttattgccttagcctgtactgaatgtgtgctgttggcagttatggcctatgatcgctacctggccatctgtggacccctcctttaccctagtctcatgccttccagtctggccactcgccttgctgctgcctcttggggcagtggcttcttcagctccatgatgaagcttctttttatttcccaattgtcctactgtggacccaacattatcaaccactttttctgtgatatttccccactactcaacctcacctgctctgacaaggagcaagcagagctagtagacttccttctggccctggtgatgattctactccctctattggctgtggtttcatcatacactgccatcattgcagccatcctgaggatccctacgtccaggggacgccacaaagccttttccacttgtgccgctcatctggcagtggttgttatctactactcctccactctcttcacctatgcacggccccgggccatgtacaccttcaaccacaacaagattatctctgtgctctacactatcattgtaccattcttcaacccagccatctactgcctgaggaacaaggaggtgaaggaggccttcaggaagacagtgatgggcagatgtcactatcctagggatgttcaggactga

SEQ ID NO: 4656 - DNA, 1002 bp, Homo sapiens
ttgctgagctctcactgccacatatgcaaccatataccaaaaactggacccaggtaactgaatttgtcatgatgggctttgctggcatccatgaagcacacctcctcttcttcatactcttcctcaccatgtacctgttcaccttggtggagaatttggccatcattttagtggtgggtttggaccaccgactacggagacccatgtatttcttcctgacacacttgtcctgccttgaaatctggtacacttctgttacagtgcccaagatgctggctggttttattggggtggatggtggcaagaatatctcttatgctgattgcctatcccagctcttcatcttcacctttcttggggcaactgagtgtttcctactggctgccatggcctatgatcgttatgtggccatttgtatgcctctccactatggggcttttgtgtcctggggcacctgcatccgtctggcagctgcctgttggctggtaggtttcctcacacccatcttgccaatctacctcttgtctcagctaacattttatggcccaaatgtcattgaccatttctcctgtgatgcctcacccttgctagccttgtcgtgctcagatgtcacttggaaggagactgtggatttcctggtgtctctggctgtgctactggcctcctctatggtcattgctgtgtcctatggcaacatcgtctggacactgctgcacatccgctcagctgctgagcgctggaaggccttctctacctgtgcagctcacctgactgtggtgagcctcttctatggcactcttttctttatgtatgtccagaccaaggtgacctcctccatcaacttcaacaaggtggtatctgtcttctactctgttgtcacgcccatgctcaatcctctcatctacagtcttaggaacaaggaagtgaagggagctctgggtcgagtcttttctctcaacttttggaagggacagtgaggaggcaggtgggaacccagtttcc

SEQ ID NO: 4657 - DNA, 996 bp, Homo sapiens
atgagtcctgatgggaaccacagtagtgatccaacagagttcgtcctggcagggctcccaaatctcaacagcgcaagagtggaattattttctgtgtttcttcttgtctatctcctgaatctgacaggcaatgtgttgattgtgggggtggtaagggctgatactcgactacagacccctatgtacttctttctgggtaacctgtcctgcctagagatactgctcacttctgtcatcattccaaagatgctgagcaatttcctctcaaggcaacacactatttcctttgctgcatgtatcacccaattctatttctacttctttctcggggcctccgagttcttactgttggctgtcatgtctgcggatcgctacctggccatctgtcatcctctgcgctaccccttgctcatgagtggggctgtgtgctttcgtgtggccttggcctgctgggtggggggactcgtccctgtgcttggtcccacagtggctgtggccttgcttcctttctgtaagcagggtgctgtggtacagcacttcttctgcgacagtggcccactgctccgcctggcttgcaccaacaccaagaagctggaggagactgactttgtcctggcctccctcgtcattgtatcttccttgctgatcactgctgtgtcctacggcctcattgtgctggcagtcctgagcatcccctctgcttcaggccgtcagaaggccttctctacctgtacctcccacttgatagtggtgaccctcttctatggaagtgccatttttctctatgtgcggccatcgcagagtggttctgtggacactaactgggcagtgacagtaataacgacatttgtgacaccactgttgaatccattcatctatgccttacgtaatgagcaagtcaaggaagctttgaaggacatgtttaggaaggtagtggcaggcgttttagggaatcttttacttgataaatgtctcagtgagaaagcagtaaagtaa

SEQ ID NO: 4658 - DNA, 1089 bp, Homo sapiens
gagttctgtttcatttcccctgcaggtgactgaagatgaaccctgaaaactggactcaggtaacaagctttgtccttctgggtttccccagtagccacctcatacagttcctggtgttcctggggttaatggtgacctacattgtaacagccacaggcaagctgctaattattgtgctcagctggatagaccaacgcctgcacatacagatgtacttcttcctgcggaatttctccttcctggagctgttgctggtaactgttgtggttcccaagatgcttgtcgtcatcctcacgggggatcacaccatctcatttgtcagctgcatcatccagtcctacctctacttctttctaggcaccactgacttcttcctcttggccgtcatgtctctggatcgttacctggcaatctgccgaccactccgctatgagaccctgatgaatggccatgtctgttcccaactagtgctggcctcctggctagctggattcctctgggtcctttgccccactgtcctcatggccagcctgcctttctgtggccccaatggtattgaccacttctttcgtgacagttggcccttgctcaggctttcttgtggggacacccacctgctgaaactggtggctttcatgctctctacgttggtgttactgggctcactggctctgacctcagtttcctatgcctgcattcttgccactgttctcagggcccctacagctgctgagcgaaggaaagcgttttccacttgcgcctcgcatcttacagtggtggtcatcatctatggcagttccatctttctctacattcgtatgtcagaggctcagtccaaactgctcaacaaaggtgcctccgtcctgagctgcatcatcacacccctcttgaacccattcatcttcactctccgcaatgacaaggtgcagcaagcactgagagaagccttggggtggcccaggctcactgctgtgatgaaactgagggtcacaagtcaaaggaaatgatcttattaaatgggagattaaatgtttattgaaaattttttaaatgtgcaagaagtttaagggatgtaggcaacactgttca

SEQ ID NO: 4659 - DNA, 1028 bp, Homo sapiens
cagggccccatactgtggatcatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtacttcttcctgggcaatttttccctgctggagatcttggtaaccatgactgcagtgcccaggatgctctcagacctgttggtcccccacaaagtcattaccttcactggctgcatggtccagttctacttccacttttccctggggtccacctccttcctcatcctgacagacatggcccttgatcgctttgtggccatctgccacccactgcgctatggcactctgatgagccgggctatgtgtgtccagctggctggggctgcctgggcagctcctttcctagccatggtacccactgtcctctcccgagctcatcttgattactgccatggcgacgtcatcaaccacttcttctgtgacaatgaacctctcctgcagttgtcatgctctgacactcgcctgttggaattctgggactttctgatggccttgacctttgtcctcagctccttcctggtgaccctcatctcctatggctacatagtgaccactgtgctgcggatcccctctgccagcagctgccagaaggctttctccacttgcgggtctcacctcacactggtcttcatcggctacagtagtaccatctttctgtatgtcaggcctggcaaagctcactctgtgcaagtcaggaaggtcgtggccttggtgacttcagttctcaccccctttctcaatccctttatccttaccttctgcaatcagacagttaaaacagtgctacaggggcagatgcagaggctgaaaggcctttgcaaggcacaatgatgagcccagggcccaggggaacctggcctgcctccattgagcagttctgtggggagggagacctc

SEQ ID NO: 4660 - DNA, 1058 bp, Homo sapiens
gcttgtctttctagggtatcaagggacatgagaaatggcacagtaatcacagaattcatcctgctaggctttcctgttatccaaggcctacaaacacctctctttattgcaatctttctcacctacatattaacccttgcaggcaatgggcttattattgccactgtgtgggctgagcccaggctacaaattccaatgtacttcttcctttgtaacttgtctttcttagaaatctggtacaccaccacagtcatccccaaactgctaggaacctttgtagtggcaagaacagtaatctgcatgtcctgctgcctgctgcaggccttcttccacttcttcgtgggcaccaccgagttcttgatcctcactatcatgtcttttgaccgctacctcaccatctgcaatccccttcaccaccccaccatcatgaccagcaaactctgcctgcagctggccctgagctcctgggtggtgggcttcaccattgtcttttgtcagacgatgctgctcatccagttgccattctgtggcaataatgttatcagtcatttctactgtgatgttgggcccagtttgaaagccgcctgcatagacaccagcattttggaactcctgggcgtcatagcaaccatccttgtgatcccagggtcacttctctttaatatgatttcttatatctacattctgtccgcaatcctacgaattccttcagccactggccaccaaaagactttctctacctgtgcctcgcacctgacagttgtctccctgctctacggggctgttctgttcatgtacctaagacccacagcacactcctcctttaagattaataaggtggtgtctgtgctaaatactatcctcaccccccttctgaatccctttatttatactattagaaacaaggaggtgaagggagccttaagaaaggcaatgacttgcccaaagactggtcatgcaaagtaaaacatgcaacacatcaaagtgagcttaatgcagataaaaacaatgaaagttgagagaggattttggagaagtttggtaaaacaggctccccc

SEQ ID NO: 4661 - DNA, 978 bp, Homo sapiens
atgaccaccataattctggaagtagataatcatacagtgacaacacgtttcattcttctggggtttccaacacgaccagccttccagcttctctttttctccattttcctggcaacctatctgctgacactgctggagaatcttcttatcatcttagctatccacagtgatgggcagctgcataagcccatgtacttcttcttgagccacctctccttcctggagatgtggtatgtcacagtcatcagccccaagatgcttgttgacttcctcagtcatgacaagagtatttccttcaatggctgcatgactcaactttacttttttgtgacctttgtctgcactgagtacatccttcttgctatcatggcctttgaccgctatgtagccatttgtaatccactacgctacccagtcatcatgaccaaccagctctgtggcacactggctggaggatgctggttctgtggactcatgactgccatgattaagatggtttttatagcacaacttcactactgtggcatgcctcagatcaatcactacttttgtgatatctctccactccttaacgtctcctgtgaggatgcctcacaggctgagatggtggacttcttcttggccctcatggtcattgctattcctctttgtgttgtggtggcatcctacgctgctatccttgccaccatcctcaggatcccttctgctcagggccgccaaaaggcattctccacctgtgcctcccacctgaccgtcgtaattctcttctattccatgacacttttcacctatgcccgtcccaaactcatgtatgcctacaattccaacaaagtggtatctgttctctacactgtcattgttccactcctcaaccccatcatttactgtctgaggaaccatgaagtaaaggcagccctcagaaagaccatacattgcagaggaagtgggccccagggaaatggggctttcagtagttaa

SEQ ID NO: 4662 - DNA, 930 bp, Homo sapiens
atgaaatcatggaacaatacaataattttagaatttcttctcctgggaatttcagaggaaccagaattgcaggccttcctctttgggctgttcctgtccatgtacctggtcactgtgctcgggaacctgctcatcatcctggccacaatctcagactcccacctccacacccccatgtacttcttcctctccaacctgtccttcgtagacatctgttttgtctctaccactgtcccgaagatgctggtgaacatccagacacacaacaaagtcatcacctatgcaggctgcatcacccagatgtgctttttcttactctttgtaggattggataacttccttctgaccgtgatggcctatgaccggtttgtggccatctgtcaccctctgcactacatggtcattatgaaccctcaactctgtggactgctggttctggcatcctggatcatgagtgttctgaattccatgttacaaagcttaatggtgttgccactgcccttttgtacacacatggaaatccctcattttttctgtgaaattaatcaggtggtccaccttgcctgttctgacacctttcttaatgacatagtgatgtattttgcagtagcgctgctgggcggtggtcccctcactgggatcctgtactcttactctaagatagtttcctccatacgtgcaatctcatcagctcaggggaagtataaggcattttccacctgtgcatctcacctctcagttgtctccttattttatggtacatgcttaggggtgtaccttagttctgctgccacccacaattcacacacaggtgctgcagcctcagtgatgtacactgtggtcacccccatgctgaaccccttcatctacagtctgaggaataaacacataaagggtgctatgaaaacattcttcagaggaaagcaatag

SEQ ID NO: 4663 - DNA, 1127 bp, Homo sapiens
ggttcagaccagcgttggcaacagagtgagagaccctgtctatgttaataaataaataaataaataaataaataaataaataaatagaaaaaaaaagatggaaccagagaatgacacagggatttcagaatttgttcttctgggactttctgaggaaccagaattgcagcccttcctctttgggctgtttctgtccatgtacctggtcactgtgctcgggaatctgctcatcatcctggccacaatctcagactcccacctccacacccccatgtacttcttcctctccaacctgtcctttgcagacatctgtttcatctccactacaatcccaaagatgctcattaacatccagacacagagcagagtcatcacctatgcaggctgcatcacccagatgtgcttttttgtactttttggagggttagacagcttactcctggctgtgatggcctatgatcggtttgtggccatctgtcatcctctgcactacacagtcatcatgaaccctcggctctgtggactcctggttctggcatcctggatgattgctgccctgaattccttgtcacaaagcttaatggtattgtggctgtccttctgcacagacttggaaatcccccactttttctgtgaacttaatcaggtcatccaccttgcctgttctgacacctttcttaatgacatggggatgtattttgcagcagggctgctggctggtggtccccttgtggggatcctttgctcttactctaagatagtttcctccatacgtgcaatctcatcagctcaggggaagtacaaggcattttccacctgtgcatcacacctctcagttgtctctttattttgttgtacgggcctaggtgtgtaccttacttctgctgcaacccacaactcacacacaagtgcaacagcctcagtgatgtacactgtggccacccccatgctgaacccctttatctacagtctgaggaataaagacataaagagggctctgaaaatgtccttcagaggaaagcaataaaagggccatttttcaagaaataactgtgatttcagagctttaagtctcatactcagaaattgtgattcacgaatcaggttgtgaaagtggaatttgctcc

SEQ ID NO: 4664 - DNA, 930 bp, Homo sapiens
gtgaaagcagggaatgagacacaaatttcagaatttcttcttctaggattttcagagaaacaagaattgcagcccttcctctttgggctgttcctgtccatgtacctggtcactgtgctcgggaacctgctcatcatcctggccgcaatctcagactcctgcctccacacccccatgtacttctttctctccaacctgtccttcgtagatatctgttttgcctccaccatggtcccaaagatgttggtgaacatccagacacagagcaaagtcattacctatgcaggttgcatcacccagatgtgcttttttgtactctttatagtgttggacagcttactcctgaccgtgatggcctatgaccagtttgtggccatctgtcaccccctgcactacacggtcatcatgagccctcagctctgtggactgctggttctggtgtcctggatcatgagtgtcctaaactccatgttacaaagcttagtgacattgcagttgtccttctgcacagacttggaaatccctcactttttctgtgaacttaatgagatgatccaccttgcctgttctgacacctttgtgaacaacatggtgatgcattttgcagctgtgctgctggacggtggtcctctcgttgggatcctttattcttactgtaggatagtttcctccatacgtgcaatctcgtcaactcaggggaagtacaaggcactttccacctgtgcatctcacctctcagttgtctccatattttatggtacggggctaggggtgtaccttagctctactatgacccaaaacttacactcaactgctgtcgcctcggtgatgtacactgtggtcacccccatgctcaaccccttcatttacagtctgaggaataaagacataaagggggctctgacacaattcttcagagggaaacaataa

SEQ ID NO: 4665 - DNA, 1048 bp, Homo sapiens
agtctccaccatcaatcatccagtgaggaatttgcacttacacaaggaactcttcctcggagagatcccctcctgtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatga

SEQ ID NO: 4666 - DNA, 3215 bp, Homo sapiens
gagacagttctccctctattgcccaggctggagtgcagtggtgtaaacatagctccctgcagttgcaaattcctgggctcaagtgatccttccatctcagcctcccgagtagctgggactacaggtgtccaccaccatgcctggctaatgacctcttcttttgtagatacatcagctacatggaagcaggaaaccaaacaggatttttagagtttatccttctcggactctctgaggatccagaactacagccgttcatatttgggctgttcctgtccatgtacctggtgacggtgctgggaaacctgctcatcatcctggccatcagctctgactcccacctccacacccccatgtacttcttcctctccaacctgtcctgggttgacatctgtttcagcacttgcatcgtccccaagatgctggtgaacatccagaccgagaacaaagccatctcctacatggactgcctcacacaggtctatttctccatgttttttcctattctggacacgctactcctgaccgtgatggcctatgaccggtttgtggctgtctgccaccctctgcactatatgatcatcatgaacccccacctctgtggcctcctggtttttgtcacctggctcattggtgtcatgacatccctcctccatatttctctgatgatgcatctaatcttctgtaaagattttgaaattccacattttttctgcgaactgacgtacatcctccagctggcctgctctgataccttcctgaacagcacgttgatatactttatgacgggtgtgctgggcgtttttcccctccttgggatcattttctcttattcacgaattgcttcatccataaggaagatgtcctcatctgggggaaaacaaaaagcactttccacctgtgggtctcacctctccgtcgtttctttattttatgggacaggcattggggtccacttcacttctgcggtgactcactcttcccagaaaatctccgtggcctcggtgatgtacactgtggtcacccccatgttgaaccccttcatctacagcctgaggaacaaggatgtgaagggagccctggggagtctcctcagcagggcagcctcttgtttgtgatggatcccttggccccaggactaagaagttttgtgagcaccaatggcaaaaatgttttattttgaaattcttactctttaaaattaaaaacatttttttatactttgagagtacaaatgcagatttcttaacatgcatttgcataagggtgaagtctgagcttttggcgtaccaattacctgaatagtgaacataaggcacttttttttcttttttgagacggagtctcactctgtctcccaggctggagtgcagtggagtgatctcggctcactgcaacctccgcctcccgggttcaagtgattcttctgtctcagcctcctgagtagctgagattacaggtgtgtgccacccatgccttttagtagagacggggtttcaccatcttggccaggctggtctcgaactcctgaccttgtgatccacctgccttggcctctcaaagtgctgggattacaggtgtgagccaccacgcccggccaaggcagtttttaaactctcactcccctctcaccttttgcagtctccagtgtccattattctgttataatgcccatgcgtatacattgtttagctcccaattataagtgagatcatgcagcatttgactttgtttctttactaccttacttaagagaatggcttccagtcccatcgatgttgctgcaaaagacatgatttcatccttttttatggctgagtagtactccattgtatatatcctcgatatctatatagatatagacatatgtagatacataccatgttttctttttttaaaaaaatttatttttatgtcagtagtttttggggtacatgtggtttttcattacacggatgagttctttagtggtgacttctgagtttttagtgtacccgtcacccaagtggtagtagtctcttattcctcacccccctcccaacctttctcccttcaagtcaccaaagttcattatattgttcatatccctttgtgtcctcatagcttagctcccacttataactgagaacatacgatatgttcatatggatcttatgtatgttggttgaacatacaaacaagtccaggtttttcattcctgagttacttcacctagagtaatgacctccagttccatccaagttgctacaaaagacattatttggttcctttttatggataagtagtattccatgctgtacatataccacaatctttatcactcattggttgatgggcacttaggttggttccatgcctttgtaattgctaattatgttgctataaacatgcaggtgtatgtgtctttttcacataatgactttgtttcctttgggtagatacccagtagtggaactgctggactgaaaggtagttctacttttagttcttttttttgttttttttttaagacagagtctcactctgttgcccaggctggagtgcagtggcgcgatctcatctcactgcaacctccacctcccaggttcaagcgattctcctgcctcaacctcctgagtagctgggactacaggcacctgccaccccacccagctaattcttctatttttagtagagacagggtttcaccatgttggccaggctggtcttgaactcctgacctcaggtgatacgcccacctcggcctcccaaagtgctgggattacaggtgtgagccactgtgcctggccttctagttctttaagataccactttaaaaaaagtccagtcctccattgatggacacgtaggttgattccatatctttgctaatgtgaatagtgccgtgataaacatgggggtgtaagttaacaattaatctccaagtaatttccttgatggcacttctgtcctatgtgctattcaaaaattgtgtccttgatcatcgttcttaattctccattagtgagttctgaacttgggtttgaagcatttgctatagctttgttatctcaagtggtggcacagagttcttaagctattgattgttcactgactttatttctatgtgtttgcatgtgggtttttgttgtttgtgtgttcgatcatgaacagatcaacagtgtttatttgttttcctactggatgaagtatgattaaaatacgtatttaaatat

SEQ ID NO: 4667 - DNA, 1215 bp, Homo sapiens
tgggtttgtcacaactgagaactattgctgagggtgtataatcctatgtgaaaacttaatttcttaattgcttgtatccaaaatatagacacagtgctagatgctggtttacttatgtcctattttccaattctctttttttttttcctcaaaaggtgtccgagctacacagagccacagaatctcacaggtgtctcagaattcctcctcctgggactctcagaggatccagaactgcagccggtcctcgctgggctgttcctgtccatgtacctggtcacggtgctggggaacctgctcatcatcctggctgtcagctctgactcccacctccacacccccatgtacttcttcctctccaacctgtccttggctgacatcggtttcacctccaccacggtccccaagatgattgtggacatgcaaactcacagcagagtcatctcctatgaaggctgcctgactcagatgtctttttttgtcctttttgcatgtatggatgacatgctcctgagtgtgatggcctatgaccggtttgtggccatctgtcaccccctgcactaccgaatcatcatgaacccacgcctctgtggcttcttaatcttgttgtctttttttattagtcttttggactcccagttgcacaatttgattatgttacagctcacctgcttcaaggatgtggacatttctaatttcttctgtgacccttctcaactcctccaccttaggtgttccgacaccttcatcaatgaaatggtcatatatttcatgggtgccatatttggctgtctccctatctcagggatccttttctcttactataaaattgtttcccccattctgagagttccaacatcagatgggaagtataaagccttctccacctgtggctctcacctggcagttgtttgcttattttatggaacagggcttgtagggtacctcagttcagctgtgttaccatcccccaggaagagtatggtggcttcagtgatgtacactgtggtcacccccatgctgaaccccttcatctacagcctgaggaacaaggacattcaaagtgccctgtgcaggctgcatggcagaatcatcaaatctcatcatctccatcctttttgttatatgggatagaaatggcagcaaaatttaacacctaggcctgcaaattctgcctccttggtcacattattttggttgcttgatggctttcat

SEQ ID NO: 4668 - DNA, 1002 bp, Homo sapiens
atgggacccagaaaccaaacagctgtttcagaatttcttctcatgaaagtgacagaggacccagaactgaagttaatccctttcagcctgttcctgtccatgtacctggtcaccatcctggggaacctgctcattctcctggctgtcatctctgactcccacctccacacccccatgtacttccttctctttaatctctcctttactgacatctgtttaaccacaaccacagtcccaaagatcctagtgaacatccaagctcagaatcagagtatcacttacacaggctgcctcacccagatctgtcttgtcttggtttttgctggcttggaaagttgctttcttgcagtcatggcctacgaccgctatgtggccatttgccacccactgaggtacacagtcctcatgaatgtccatttctggggcttgctgattcttctctccatgttcatgagcactatggatgccctggttcagagtctgatggtattgcagctgtccttctgcaaaaacgttgaaatccctttgttcttctgtgaagtcgttcaggtcatcaagctcgcctgttctgacaccctcatcaacaacatcctcatatattttgcaagtagtgtatttggtgcaattcctctctctggaataattttctcttattctcaaatagtcacctctgttctgagaatgccatcagcaagaggaaagtataaagcgttttccacctgtggctgtcacctctctgttttttccttgttctatgggacagcttttggggtgtacattagttctgctgttgctgagtcttcccgaattactgctgtggcttcagtgatgtacactgtggtccctcaaatgatgaaccccttcatctacagcctgagaaataaggagatgaagaaagctttgaggaaacttattggctggagtacagtggcacgatctcggctcactgcaaactccgcctcccgggttcatgcaattctcctgcctcggcctcccgagtag

SEQ ID NO: 4669 - DNA, 936 bp, Homo sapiens
atgggacccagaaaccaaacagctgtttcagaatttcttctcatgaaagtgacagaggacccagaactgaagttaatccctttcagcctgttcctgtccatgtacctggtcaccatcctggggaacctgctcattctcctggctgtcatctctgactcccacctccacacccccatgtacttccttctctttaatctctcctttactgacatctgtttaaccacaaccacagtcccaaagatcctagtgaacatccaagctcagaatcagagtatcacttacacaggctgcctcacccagatctgtcttgtcttggtttttgctggcttggaaagttgctttcttgcagtcatggcctacgaccgctatgtggccatttgccacccactgaggtacacagtcctcatgaatgtccatttctggggcttgctgattcttctctccatgttcatgagcactatggatgccctggttcagagtctgatggtattgcagctgtccttctgcaaaaacgttgaaatccctttgttcttctgtgaagtcgttcaggtcatcaagctcgcctgttctgacaccctcatcaacaacatcctcatatattttgcaagtagtgtatttggtgcaattcctctctctggaataattttctcttattctcaaatagtcacctctgttctgagaatgccatcagcaagaggaaagtataaagcgttttccacctgtggctgtcacctctctgttttttccttgttctatgggacagcttttggggtgtacattagttctgctgttgctgagtcttcccgaattactgctgtggcttcagtgatgtacactgtggtccctcaaatgatgaaccccttcatctacagcctgagaaataaggagatgaagaaagctttgaggaaacttattggtaggctgtttcctttttag

SEQ ID NO: 4670 - DNA, 1038 bp, Homo sapiens
atgccgatgcagctgctgcttacagattttattatcttttccatcagattcatcatcaacagcatggaagcgagaaaccaaacagctatttcaaaattccttctcctgggactgatagaggatccggaactgcagcccgtccttttcagcctgttcctgtccatgtacttggtcaccatcctggggaacctgctcatcctcttggctgtcatctctgactctcacctccacacccccatgtacttcttcctctccaatctctcctttttggacatttgtttaagcacaaccacgatcccaaagatgctggtgaacatccaagctcagaatcggagcatcacgtactcaggctgcctcacccagatctgctttgtcttgttttttgctggcttggaaaattgtctccttgcagcaatggcctatgaccgctatgtggccatttgtcacccccttagatacacagtcatcatgaacccccgcctctgtggcctgctgattcttctctctctgttgactagtgttgtgaatgcccttcttctcagcctgatggtgttgaggctgtccttctgcacagacctggaaatcccgctcttcttctgtgaactggctcaggtcatccaactcacctgttcagacaccctcatcaataacatcctgatatattttgcagcttgcatatttggtggtgttcctctgtctggaatcattttgtcttacactcagatcacctcctgtgttttgagaatgccatcagcaagtggaaagcacaaagcagtttccacctgtgggtctcacctctccattgttctcttgttctatggggcaggtttgggggtgtacattagttctgtggttactgactcacctaggaagactgcagtggcttcagtgatgtattctgtgttccctcaaatggtgaacccctttatctatagtctgaggaataaggacatgaaaggaaccttgaggaagttcatagggaggataccttctcttctgtggtgtgccatttgctttggattcaggtttctagagtaa

SEQ ID NO: 4671 - DNA, 939 bp, Homo sapiens
atgaaagcaggaaacttctcagacactccagaattctttctcttgggattgtcaggggatccggagctgcagcccatcctcttcatgctgttcctgtccatgtacctggccacaatgctggggaacctgctcatcatcctggccgtcaactctgactcccacctccacacccccatgtacttcctcctctctatcctgtccttggtcgacatctgtttcacctccaccacgatgcccaagatgctggtgaacatccaggcacaggctcaatccatcaattacacaggctgcctcacccaaatctgctttgtcctggtttttgttggattggaaaatggaattctggtcatgatggcctatgatcgatttgtggccatctgtcacccactgaggtacaatgtcatcatgaaccccaaactctgtgggctgctgcttctgctgtccttcatcgttagtgtcctggatgctctgctgcacacgttgatggtgctacagctgaccttctgcatagacctggaaattccccactttttctgtgaactagctcatattctcaagctcgcctgttctgatgtcctcatcaataacatcctggtgtatttggtgaccagcctgttaggtgttgttcctctctctgggatcattttctcttacacacgaattgtctcctctgtcatgaaaattccatcagctggtggaaagtataaagctttttccatctgcgggtcacatttaatcgttgtttccttgttttatggaacagggtttggggtgtaccttagttctggggctacccactcctccaggaagggtgcaatagcatcagtgatgtataccgtggtcacccccatgctgaacccactcatttacagcctgagaaacaaggacatgttgaaggctttgaggaaactaatatctaggataccatctttccattga

SEQ ID NO: 4672 - DNA, 1145 bp, Homo sapiens
catcagcagagagcccaggatgtttcactagcaccaaaggctcaagactagccgtccaagattagccttttaatggggttcttgtctcccatgcatccctgcaggcctcccacccagaggagaatggctgcaggaaatcactctacagtgacagagttcattctcaagggtttaacgaagagagcagacctccagctccccctctttctcctcttcctcgggatctacttggtcaccatcgtggggaacctgggcatgatcactctaatttgtctgaactctcagctgcacacccccatgtactactttctcagcaatctgtcactcatggatctctgctactcctccgtcattacccctaagatgctggtgaactttgtgtcagagaaaaacatcatctcctacgcagggtgcatgtcacagctctacttcttccttgtttttgtcattgctgagtgttacatgctgacagtgatggcctacgaccgctatgttgccatctgccaccctttgctttacaacatcattatgtctcatcacacctgcctgctgctggtggctgtggtctacgccatcggactcattggctccacaatagaaactggcctcatgttaaaactgccctattgtgagcacctcatcagtcactacttctgtgacatcctccctctcatgaagctgtcctgctctagcacctatgatgttgagatgacagtcttcttttcggctggattcaacatcatagtcacgagcttaacagttcttgtttcttacaccttcattctctccagcatcctcggcatcagcaccacagaggggagatccaaagccttcagcacctgcagctcccaccttgcagccgtgggaatgttctatggatcaactgcattcatgtacttaaaaccctccacaatcagttccttgacccaggagaatgtggcctctgtgttctacaccacggtaatccccatgttgaatcccctaatctacagcctgaggaacaaggaagtaaaggctgccgtgcagaaaacgctgaggggtaaactgttttgatgcaaatgttattgttccttttcaatttagtggtaattgttataaataccagagtgacagcttctgaatgctggccagctgtggatggaaaa

SEQ ID NO: 4673 - DNA, 998 bp, Homo sapiens
cgactctcctgcctgaccaaaaagaatggcagccaaaaactcttctgtgacagagtttatcctcgaaggcttaacccaccagccgggactgcggatccccctcttcttcctgtttctgggtttctacacggtcaccgtggtggggaacctgggcttgataaccctgattgggctgaactctcacctgcacactcccatgtacttcttcctttttaacctctctttaatagatttctgtttctccactaccatcactcccaaaatgctgatgagttttgtctcaaggaagaacatcatttccttcacagggtgtatgactcagctcttcttcttctgcttctttgtcgtctctgagtccttcatcctgtcagcgatggcgtatgaccgctacgtggccatctgtaacccactgttgtacacagtcaccatgtcttgccaggtgtgtttgctccttttgttgggtgcctatgggatggggtttgctggggccatggcccacacaggaagcataatgaacctgaccttctgtgctgacaaccttgtcaatcatttcatgtgtgacatccttcctctccttgagctctcctgcaacagctcttacatgaatgagctggtggtctttattgtggtggctgttgacgttggaatgcccattgtcactgtctttatttcttatgccctcatcctctccagcattctacacaacagttctacagaaggcaggtccaaagcctttagtacttgcagttcccacataattgtagtttctcttttctttggttctggtgctttcatgtatctcaaacccctttccatcctgcccctcgagcaagggaaagtgtcctccctgttctataccataatagtccccgtgttaaacccattaatctatagcttgaggaacaaggatgtcaaagttgccctgaggagaactttgggcagaaaaatcttttcttaagaaaggattagtattggaggaaggagatacaatgctttgc

SEQ ID NO: 4674 - DNA, 968 bp, Homo sapiens
agatttttgaagacaaaaaatgctggctagaaacaactccttagtgactgaatttattcttgctggattaacagatcatccagagttccggcaacccctctttttcctgtttctagtgatctacattgtcaccatggtaggcaaccttggcttgatcactcttttcggtctaaattctcacctccacacaccaatgtactatttcctcttcaatctctccttcattgatctctgttactcctctgttttcactcccaaaatgctaatgaactttgtgtcaaaaaagaatattatctccaatgttgggtgcatgactcggctgtttttctttctctttttcgtcatctctgaatgttacatgttgacttcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtactaatatcacggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcccctcatctacagtttgaggaacaaggatgtcaaagttgcactgaggaaagctctgattaaaattcagaggagaaatatattctaattagaag

SEQ ID NO: 4675 - DNA, 987 bp, Homo sapiens
atttttgaagacaaaaaatgctggctagaaacaactccttagtgactgaatttattcttgctggattaacagatcatccagagttccagcaacccctctttttcctgtttctagtggtctacattgtcaccatggtaggcaaccttggcttgatcattcttttcggtctaaattctcacctccacacaccaatgtactatttcctcttcaatctctccttcattgatctctgttactcctctgttttcactcccaaaatgctaatgaactttgtatcaaaaaagaatattatctcctatgttgggtgcatgactcagctgtttttctttctcttttttgtcatctctgaatgttacatgttgacctcaatggcatatgatcgctatgtggccatctgtaatccattgctgtataaggtcaccatgtcccatcaggtctgttctatgctcacttttgctgcttacataatgggattggctggagccacggcccacaccgggtgcatgcttagactcaccttctgcagtgctaatatcatcaaccattacttgtgtgacatactccccctcctccagctttcctgcaccagcacctatgtcaacgaggtggttgttctcattgttgtgggtattaatatcatggtacccagttgtaccatcctcatttcttatgttttcattgtcactagcattcttcatatcaaatccactcaaggaagatcaaaagccttcagtacttgtagctctcatgtcattgctctgtctctgttttttgggtcagcggcattcatgtatattaaatattcttctggatctatggagcagggaaaagtttcttctgttttctacactaatgtggtgcccatgctcaatcctctcatctacagtttgaggaacaaggatgtcaaagttgcactgaggaaagctctgattaaaattcagagaagaaatatattctaattagaagcagtaataatgtaaaacgatt

SEQ ID NO: 4676 - DNA, 983 bp, Homo sapiens
ccagacagctcgccaagagagaatgactctgagaaacagctcctcagtgactgagtttatccttgtgggattatcagaacagccagagctccagctccctcttttccttctattcttagggatctatgtgttcactgtggtgggcaacttgggcttgatcaccttaattgggataaatcctagccttcacacccccatgtactttttcctcttcaacttgtcctttatagatctctgttattcctgtgtgtttacccccaaaatgctgaatgactttgtttcagaaagtatcatctcttatgtgggatgtatgactcagctatttttcttctgtttctttgtcaattctgagtgctatgtgttggtatcaatggcctatgatcgctatgtggccatctgcaaccccctgctctacatggtcaccatgtccccaagggtctgctttctgctgatgtttggttcctatgtggtagggtttgctggggccatggcccacactggaagcatgctgcgactgaccttctgtgattccaacgtcattgaccattatctgtgtgacgttctccccctcttgcagctctcctgcaccagcacccatgtcagtgagctggtatttttcattgttgttggagtaatcaccatgctatccagcataagcatcgtcatctcttacgctttgatactctccaacatcctctgtattccttctgcagagggcagatccaaagcctttagcacatggggctcccacataattgctgttgctctgttttttgggtcagggacattcacctacttaacaacatcttttcctggctctatgaaccatggcagatttgcctcagtcttttacaccaatgtggttcccatgcttaacccttcgatctacagtttgaggaataaggatgataaacttgccctgggcaaaaccctgaagagagtgctcttctaatgggtctcttcatatcactggcaaccgattc

SEQ ID NO: 4677 - DNA, 1033 bp, Homo sapiens
ggagggcagcagtggtctctctctctctctaaataactttttcccttgtccccacagaatgccttaaatgacaatggctgctgagaattcctccttcgtgacacagtttatcctcgcaggcttaactgaccaaccgggagtccagatccccctcttcttcctgtttctaggcttctacgtggtcactgtggtggggaacctgggcttgataaccctgataaggctcaactctcacttgcacacccctatgtacttcttcctctataacttgtccttcatagatttctgctattccagtgttatcactcccaaaatgctgatgagctttgtcttaaagaagaacagcatctcctacgcagggtgtatgactcagctcttcttctttcttttctttgttgtctctgagtccttcatcctgtcagcaatggcgtatgaccgctatgtggccatctgtaacccactgttgtacatggtcaccatgtctccccaggtgtgttttctccttttgttgggtgtctatgggatggggtttgctggggccatggcccacacagcgtgcatgatgggtgtgaccttctgtgccaataaccttgtcaaccactacatgtgtgacatccttccccttcttgagtgtgcttgcaccagcacctatgtgaatgagcttgtagtgtttgttgttgtgggcattgatattggtgtgcccacagtcaccatcttcatttcctatgctctcattctctccagcatcttccacattgattccacggagggcaggtccaaagccttcagcacctgcagctcccacataattgcagtttctctgttctttgggtcaggagcattcatgtacctcaaacccttttctcttttagctatgaaccagggcaaggtgtcttccctattctataccactgtggtgcccatgctcaacccattaatttatagcctgaggaataaggacgtcaaagttgctctaaagaaaatcttgaacaaaaatgcattctcctgagaaaagggcaatgctcaggaaaga

SEQ ID NO: 4678 - DNA, 1026 bp, Homo sapiens
ttggaagagcagtgagggtccatgttaaggtaattcatactttctattttcacagaaatgcctaaagaagaatgaccatggaaaattattctatggcagctcagtttgtcttagatggtttaacacagcaagcagagctccagctgcccctcttcctcctgttcctgggaatctatgtggtcacagtagtgggcaacctgggcatgattctcctgattgcagtcagccctctacttcacacccccatgtactatttcctcagcagcttgtccttcgtcgatttctgctattcctctgtcattactcccaaaatgctggtgaacttcctaggaaagaagaatacaatcctttactctgagtgcatggtccagctctttttctttgtggtctttgtggtggctgagggttacctcctgactgccatggcatatgatcgctatgttgccatctgtagcccactgctttataatgcgatcatgtcctcatgggtctgctcactgctagtgctggctgccttcttcttgggctttctctctgccttgactcatacaagtgccatgatgaaactgtccttttgcaaatcccacattatcaaccattacttctgtgatgttcttcccctcctcaatctctcctgctccaacacacacctcaatgagcttctactttttatcattgcggggtttaacaccttggtgcccaccctagctgttgctgtctcctatgccttcatcctctacagcatccttcacatccgctcctcagagggccggtccaaagcttttggaacatgcagctctcatctcatggctgtggtgatcttctttgggtccattaccttcatgtatttcaagcccccttcaagtaactccctggaccaggagaaggtgtcctctgtgttctacaccacggtgatccccatgctgaaccctttaatatacagtctgaggaataaggatgtgaagaaagcattaaggaaggtcttagtaggaaaatgagtcctgatttgggggatttatagatggg

SEQ ID NO: 4679 - DNA, 1051 bp, Homo sapiens
tggggcatgtcattctgctttgggaatcagaaaataaatctaatgtctctcttttctcttatttcttattacacataataccttaaaagacatggctacttcaaaccattcttcaggggctgagtttatcctggcaggcttgacacaacgcccagaacttcaactgccactcttcctcctgttccttggaatatatgtggtcacagtggtggggaacctgggcatgatcttcttaattgctctcagttctcaactttaccctccagtgtattattttctcagtcatttgtctttcattgatctctgctactcctctgtcattacccctaagatgctggtgaactttgttccagaggagaacattatctcctttctggaatgcattactcaactttatttcttccttatttttgtaattgcagaaggctaccttctgacagccatggaatatgaccgttatgttgctatctgtcgcccactgctttacaatattgtcatgtcccacagggtctgttccataatgatggctgtggtatactcactgggttttctgtgggccacagtccatactacccgcatgtcagtgttgtcattctgtaggtctcatacggtcagtcattatttttgtgatattctccccttattgactctgtcttgctccagcacccacatcaatgagattctgctgttcattattggaggagttaataccttagcaactacactggcggtccttatctcttatgctttcattttctctagtatccttggtattcattccactgaggggcaatccaaagcctttggcacttgtagctcccatctcttggctgtgggcatcttttttgggtctataacattcatgtatttcaagcccccttccagcactactatggaaaaagagaaggtgtcttctgtgttctacatcacaataatccccatgctgaatcctctaatctatagcctgaggaacaaggatgtgaaaaatgcactgaagaagatgactaggggaaggcagtcatcctgacaaagagggttctcattggcagcc

SEQ ID NO: 4680 - DNA, 1075 bp, Homo sapiens
ctctcatctccacagatttctcagagaagaatgggtgtaaaaaaccattccacagtgactgagtttcttctttcaggattaactgaacaagcagagcttcagctgcccctcttctgcctcttcttaggaatttacacagttactgtggtgggaaacctcagcatgatctcaattattaggctgaatcgtcaacttcatacccccatgtactatttcctgagtagtttgtcttttttagatttctgctattcttctgtcattacccctaaaatgctatcagggtttttatgcagagatagatccatctcctattctggatgcatgattcagctgttttttttctgtgtttgtgttatttctgaatgctacatgctggcagccatggcctgcgatcgctacgtggccatctgcagcccactgctctacagggtcatcatgtcccctagggtctgttctctgctggtggctgctgtcttctcagtaggtttcactgatgctgtgatccatggaggttgtatactcaggttgtctttctgtggatcaaacatcattaaacattatttctgtgacattgtccctcttattaaactctcctgctccagcacttatattgatgagcttttgatttttgtcattggtggatttaacatggtggccacaagcctaacaatcattatttcatatgcttttatcctcaccagcatcctgcgcatccactctaaaaagggcaggtgcaaagcgtttagcacctgtagctcccacctgacagctgttcttatgttttatgggtctctgatgtccatgtatctcaaacctgcttctagcagttcactcacccaggagaaagtatcctcagtattttataccactgtgattctcatgttgaatcccttgatatatagtctgaggaacaatgaagtaagaaatgctctgatgaaacttttaagaagaaaaatatctttatctccaggataaatatgctctttattaagatctatttctgtattcataatcatgattatatgtatatatttataccttgactatttaaaagtaatttgaggtccaggtacgg

SEQ ID NO: 4681 - DNA, 1038 bp, Homo sapiens
tctcagcagtttaaagcaattgaacatcatgggtagaagaaataacacaaatgtgcctgacttcatccttacgggactgtcagattctgaagaggtccagatggccctctttatactatttctcctgatatacctaattactatgctgggcaatgtggggatgatattgataatccgcctggacctccagcttcacactcccatgtattttttccttactcacttgtcatttattgacctcagttactcaactgtcatcacacctaaaaccttagcgaacttactgacttccaactatatttccttcatgggctgctttgcccagatgttcttttttgtcttcttgggagctgctgaatgttttcttctctcatcaatggcctatgatcgctacgtagctatctgcagtcctctacgttacccagttattatgtccaaaaggctgtgttgcgctcttgtcactgggccctatgtgattagctttatcaactcctttgtcaatgtggtttggatgagcagactgcatttctgcgactcaaatgtagttcgtcactttttctgcgacacgtctccaattttagctctgtcctgcatggacacatacgacattgaaatcatgatacacattttagctggttccaccctgatggtgtcccttatcacaatatctgcatcctatgtgtccattctctctaccatcctgaaaattaattccacttcaggaaagcagaaagctttgtctacttgtgcctctcatctcttgggagtcaccatcttttatggaactatgatttttacttatttaaaaccaagaaagtcttattctttgggaagggatcaagtggcttctgttttttatactattgtgattcccatgctgaatccactcatttatagtcttagaaacaaagaagttaaaaatgctctcattagagtcatgcagagaagacaggactccaggtaattaaaatagcaggaatgctgaacatttaaactcatcttttctttcttttctatttggtatgtccttggtctccc

SEQ ID NO: 4682 - DNA, 927 bp, Homo sapiens
aataacacaaatgtgcctgacttcatccttacgggactgtcagattctgaagaggtccagatggccctctttatactatttctcctgatatacctaattactatgctgggcaatgtggggatgatattgataatccgcctggacctccagcttcacactcccatgtattttttccttactcacttgtcatttattgacctcagttactcaactgtcatcacacctaaaaccttagcgaacttactgacttccaactatatttccttcatgggctgctttgcccagatgttcttttttgtcttcttgggagctgctgaatgttttcttctctcatcaatggcctatgatcgctacgtagctatctgcagtcctctacgttacccagttattatgtccaaaaggctgtgttgcgctcttgtcactgggccctatgtgattagctttatcaactcctttgtcaatgtggtttggatgagcagactgcatttctgcgactcaaatgtagttcgtcactttttctgcgacacgtctccaattttagctctgtcctgcatggacacatacgacattgaaatcatgatacacattttagctggttccaccctgatggtgtcccttatcacaatatctgcatcctatgtgtccattctctctaccatcctgaaaattaattccacttcaggaaagcagaaagctttgtctacttgtgcctctcatctcttgggagtcaccatcttttatggaactatgatttttacttatttaaaaccaagaaagtcttattctttgggaagggatcaagtggcttctgttttttatactattgtgattcccatgctgaatccactcatttatagtcttagaaacaaagaagttaaaaatgctctcattagagtcatgcagagaatttggtatgtccttggtctc

SEQ ID NO: 4683 - DNA, 939 bp, Homo sapiens
atgatgggtagaaggaataacacaaatgtggctgacttcatccttatgggactgacactttctgaagagatccagatggctctgtttatgctatttctcctgatatacctaattactatgctggggaatgtggggatgatattgataatccgcctggacctccagcttcacactcccatgtattttttccttactcacctgtcatttattgacctcagttactcaactgtcgtcacacctaaaaccttagcgaacttactgacttccaactatatttcctttacgggctgctttgcccagatgttcttttttgccttcttgggtactgctgaatgttaccttctctcctcaatggcccatgatcgctatgcagcgatctgcagtcctctacactacacagttattatgtccaaaaggctctgcctcgctctcatcactgggccttatgtgattggctttatagactcctttgtcaacgtggtttccatgagcagattgcatttctacgactcaaacgtaattcatcactttttctgtgacacttccccaattttagctctgtcctgcactgatacatacaacaccgaaatcctgatattcattattgttggttccaccctgatggtgtcccttttcacaatatctgcatcctatgtgttcattctctttaccatcctgaaaattaattccacttcaggaaagcagaaagctttctctacttgcgtctctcatctcttgggagtcaccatcttttatagcactctgatttttacttatttaaaaccaagaaagtcttattccttgggaagagatcaagtggcttctgttttttatactattgtgattcccgtgctgaatccactcatttatagtcttagaaacaaagaggtgaaaaatgctgtcatcagagtcatgcagagaagacaggactccaggtaa

SEQ ID NO: 4684 - DNA, 939 bp, Homo sapiens
atgatgggtagaaggaatgacacaaatgtggctgacttcatccttacgggactgtcagactctgaagaggtccagatggctctgtttatgctatttctcctcatatacctaattactatgctggggaatgtggggatgctattgataatccgcctggacctccagcttcacactcccatgtattttttccttactcacctgtcatttattgacctcagttactcaactgtcgtcacacctaaaaccttagcgaacttactgacttccaactatatttccttcacgggctgctttgcccagatgttctgttttgtcttcttgggtactgctgaatgttatcttctctcctcaatggcctatgatcgctatgcagcgatctgcagtcctctacactacacagttattatgcccaaaaggctctgcctcgctctcatcactgggccttatgtgattggctttatggactcctttgtcaatgtggtttccatgagcagattgcatttctgtgactcaaacataattcatcactttttctgtgacacttccccaattttagctctgtcctgcactgacacagacaacactgaaatgctgatattcattatcgctggttccaccctgatggtgtcccttatcacaatatctgcatcctatgtgtccattctctctaccatcctgaaaattaattccacttcaggaaagcagaaagctttctctacttgcgtctctcatctcttgggagtcaccatcttctatggaactatgatttttacttacttaaagccaagaaagtcttattccttgggaagagatcaagtggctcctgtgttttatactattgtgattcccatgctgaatccactcatttatagtcttagaaacagagaagtgaaaaatgctctcattagagtcatgcagagaagacaggactccaggtag

SEQ ID NO: 4685 - DNA, 1010 bp, Homo sapiens
gcaggtaagtcaaaggcctgagttgatgtaaatggctggcaacaatttcactgaggttaccgtcttcatcctctctggatttgcaaatcaccctgaattacaagtcagtcttttcttgatgtttctcttcatttatctattcactgttttgggaaacctgggactgatcacgttaatcagaatggattctcagcttcacacccctatgtactttttcctgagcaatttagcatttattgacatattttactcctctactgtaacacctaaggcattggtgaatttccaatccaatcggagatccatctcctttgttggctgctttgttcaaatgtacttttttgttggattggtgtgttgtgagtgtttccttctgggatcaatggcctacaatcgctacatagcaatctgcaatcccttactgtattcagtagtcatgtcccaaaaagtgtccaactggctgggagtaatgccatatgtgataggcttcacaagctcgctgatatctgtctgggtgataagcagtttggcgttctgtgattccagcatcaatcattttttttgtgacaccacagctcttttagcactctcctgtgtagatacattcggcacagaaatggtgagctttgtcttagctggattcactcttcttagctctctccttatcatcacagtcacttatatcatcatcatctcagccatcctgaggatccagtcagcagcaggcaggcagaaggccttctccacctgcgcatcccacctcatggctgtaactatcttttatgggtctctgattttcacctatttgcaacctgataacacatcatcgctgacccaggcgcaggtggcatctgtattctatacgattgtcattcccatgctgaatccactcatctacagtctgaggaacaaagatgtgaaaaatgctcttctgagagtcatacatagaaaactttttccatgacaaatttatgtatgttacaattaaaacaaaggtggatggcttcagg

SEQ ID NO: 4686 - DNA, 1074 bp, Homo sapiens
tcccccaaacagatgaatttccaaactctgacatggctcctgaaaatttcaccagagtcactgagtttattcttacaggtgtctctagctgtccagagctccagattcccctcttcctggtctttctggtgctctatgggctgaccatggcagggaacctgggcatcatcaccctcaccagtgttgactctcgacttcaaacccccatgtactttttcctgcaacatctggctctcattaatcttggtaactctactgtcattgcccctaaaatgctgattaactttttagtaaagaagaaaactacctcattctatgaatgtgccacccaactgggagggttcttgttctttattgtatcggaggtaatcatgctggctttgatggcctatgaccgctatgtggctatttgtaaccctctgctgtacatggtggtggtgtctcggcggctctgcctcctgctggtctccctcacatacctctatggcttttctacagctattgtggtttcatcttatgtattctctgtgtcttattgctcttctaatataatcaatcatttttactgtgataatgttcctctgttagcattatcttgctctgatacttacttaccagaaacagttgtctttatatctgcagcaacaaatgtggttggttccttgattatagttctagtatcttatttcaatattgttttgtctattttaaaaatatgttcatcagaaggaaggaaaaaagccttttctacctgtgcttcacatatgatggcagtcacaattttttatgggacattgctattcatgtatgtgcagccccgaagtaaccattcactggatactgatgataagatggcttctgtgttttacacgttggtaattcctatgctgaatcccttgatctacagcctgaggaataaggatgtgaagactgctctacagagattcatgacaaatctgtgctattcctttaaaacaatgtaattttaaacagtacaggtaaatgaggagagagttaatataagctgccattatgtaaaagaaaatgtaggaaaaagaaaaggtaggtagccga

SEQ ID NO: 4687 - DNA, 948 bp, Homo sapiens
atggctcctgaaaatttcaccagggtcactgagtttattctcacaggtgtctctagctgtccagagctccagattcccctcttcctggtcttcctagtgctctatgtgctgaccatggcagggaacctgggcatcatcaccctcaccagtgttgactctcgacttcaaaaccccatgtactttttcctgagacatctagctatcatcaatcttggcaactctactgtcattgcccctaaaatgctgatgaactttttagtaaagaagaaaactacctcattctatgaatgtgccacccaactgggagggttcttgttctttattgtatcggaggtaatgatgctggctgtgatggcctatgaccgctatgtggccatttgtaaccctctgctctacatggtggtggtgtctcggcggctctgcctcctgctggtgtccctcacatacctctatggcttttctacagctattgtggtttcaccttgtatattctctgtgtcttattgctcttctaatataatcaatcatttttactgtgatattgcacctctgttagcattatcttgctctgatacttacataccagaaacaatagtctttatatctgcagcaacaaatttggttttttccatgattacagttctagtatcttatttcaatattgttttgtccattctaaggatacgttcaccagaaggaaggaaaaaagccttttccacctgcgcttcgcatatgatagcagtcacggttttctatgggacaatgctatttatgtatttgcagccccaaaccaaccactcactggatactgataagatggcttctgtgttttacacattggtgattcctatgctgaatcccttgatctacagcctgaggaataatgatgtaaatgttgccttaaagaaattcatggaaaatccatgttactcctttaaatcaatgtaa

SEQ ID NO: 4688 - DNA, 1087 bp, Homo sapiens
cctctattgctcatacatcaaattgttaattttcttagaagataatgtttcaaatataataaatattgattttctagtttgcacagttaccaagatgaatcatgtggtaaaacacaatcacacggcagtgaccaaggtgactgaatttattctcatggggattacagacaaccctgggctgcaggctccactgtttggactcttcctcatcatatatctggtcacagtgataggcaatctgggcatggttatcttgacctacttggactccaagctacacacccccatgtactttttccttagacatttgtcaatcactgatcttggttactccactgtcattgccccgaagatgttagtaaacttcatagtgcacaaaaacacaatttcttacaattggtatgccactcagctagcattctttgagattttcatcatctctgagctctttattctatcagcaatggcctatgatcgctacgtagccatctgtaaacctcttctgtacgtgatcatcatggcagagaaagtactttgggtgctggtaattgttccctatctctatagcacgtttgtgtcactatttctcacaattaagttatttaaactgtccttctgtggctcaaacataatcagctatttttactgtgactgtatccctctgatgtccatactctgttctgacacaaatgaattagaattaataattttgatcttctcaggctgtaatttgctcttctccctctcaattgttctcatatcctacatgtttattctagtggccattctcagaatgaactcaaggaaagggaggtacaaagccttctccacctgtagctctcatctgacagtggtgatcatgttctatgggacattgttatttatttacttgcaacccaagtccagtcatactttggctattgataaaatggcctcagtgttttataccctgttgattcctatgctgaatccgttgatctacagcctaaggaacaaagaagtaaaagatgctctaaagagaactttaaccaatcgattcaaaattcccatttaatatcttaatactcagttgcatagttgggtacaa

SEQ ID NO: 4689 - DNA, 939 bp, Homo sapiens
atggaacaacacaatctaacaacggtgaatgaattcattcttacgggaatcacagatatcgctgagctgcaggcaccattatttgcattgttcctcatgatctatgtgatctcagtgatgggcaatttgggcatgattgtcctcaccaagttggactccaggttgcaaacccctatgtacttttttctcagacatctggctttcatggatcttggttattcaacaactgtgggacccaaaatgttagtaaattttgttgtggataagaatataatttcttattatttttgtgcaacacagctagctttctttcttgtgttcattggtagtgaactttttattctctcagccatgtcctacgacctctatgtggccatctgtaaccctctgctatacacagtaatcatgtcacgaagggtatgtcaggtgctggtagcaatcccttacctctattgcacattcatttctcttctagtcaccataaagatttttactttatccttctgtggctacaacgtcattagtcatttctactgtgacagtctccctttgttacctttgctttgttcaaatacacatgaaattgaattgataattctgatctttgcagctattgatttgatttcatctcttctgatagttcttttatcttacctgctcatccttgtagccattctcaggatgaattctgctggcagacaaaaggctttttctacctgtggagcccacctgacagtggtcatagtgttctatgggactttgcttttcatgtacgtgcagcccaagtccagtcattcctttgacactgataaagtggcttccatattttacaccctggttatccccatgttgaatcccttgatctatagtttacgaaacaaagatgtaaaatatgccctacgaaggacatggaataacttatgtaatatttttgtttaa

SEQ ID NO: 4690 - DNA, 924 bp, Homo sapiens
atgggccaacacaatctaacagtgctaactgaattcattctgatggaactcacaaggcggcctgagctgcagattcccctttttggagtcttcctcgtcatctacctaatcacagtggtgggcaacctaactatgatcattttgaccaaactggactcccacttacatacacctatgtacttttctatcagacatttggcttttgttgatcttggtaattctactgtcatttgtcccaaggtgctggcaaattttgttgtggatcgaaatactatttcctattatgcatgtgctgcacagctggcattcttccttatgttcattatcagtgaatttttcatcctgtcagccatggcctatgaccgctatgtggccatttgtaaccctctgctctattatgttattatgtctcagcgactgtgtcatgtactggtgggcattcaatatctctacagcacatttcaggctctgatgttcactattaagatttttacattgaccttctgtggctctaatgtcatcagtcatttttactgtgatgatgttcctttgctacctatgctttgctcaaatgcacaggaaatagaattgttgagcatactattttctgtatttaatttgatctcctcctttctgatagtcttagtgtcctacatgttgattttgttagctatatgtcaaatgcattctgcagagggcaggaaaaaggctttctccacatgtggttcccatttgacagtggtggttgtgttctatgggtctctactcttcatgtacatgcagcccaattccactcacttctttgatactgataaaatggcttctgtgttttacactttagtaatccccatgcttaaccctttgatttacagcttaagaaacgaagaggtgaaaaatgccttctataagctctttgagaattga

SEQ ID NO: 4691 - DNA, 1080 bp, Homo sapiens
atggccttggggaatcacagcaccatcaccgagttcctcctccttgggctgtctgccgaccccaacatccgggctctgctctttgtgctgttcctggggatttacctcctgaccataatggaaaacctgatgctgctgctcatgatcagggctgattcttgtctccataagcccatgtatttcttcctgagtcacctctcttttgttgatctctgcttctcttcagtcattgtgcccaagatgctggagaacctcctgtcacagaggaaaaccatttcagtagagggctgcctggctcaggtcttctttgtgtttgtcactgcagggactgaagcctgccttctctcagggatggcctatgaccgccatgctgccatctgccgcccactactttatggacagatcatgggtaaacagctgtatatgcaccttgtgtggggctcatggggactgggctttctggacgcactcatcaatgtcctcctagctgtaaacatggtcttttgtgaagccaaaatcattcaccactacagctatgagatgccatccctcctccctctgtcctgctctgatatctccagaagcctcatcgccttgctctgctccactctcctacatgggctgggaaacttccttttggtcttcttatcctacacccgtataatctctaccatcctaagcatcagctctacctcgggcagaagcaaggccttctccacctgctctgcccacctcactgcagtgacactttactatggctcaggtttgctccgccatctcatgccaaactcaggttcccccatagagttgatcttctctgtgcagtatactgtagtcactcccatgctgaattccctcatctatagcctgaaaaataaggaagtgaagggggaaagaagcctccgggacagcagtcatttgcctcagctgcacaaaggccaggccagatggaagagaccagccttcaccgaaggccgcagggagcccggacacccggagctgagcattccggtcacgcctcaaccccaaggggcctgcgcatgctccgcgctgcgcgcggcgcccacggccctgccctga

SEQ ID NO: 4692 - DNA, 930 bp, Homo sapiens
atggctcacatcaattgcacccaggcgacagagtttattcttgtgggcctcacagaccatcaggagttgaagatgcccctctttgtgctattcttatccatctacctcttcacagtggtaggcaacttgggtttgatcctactcattagagcggatacaagtctcaacacaccaatgtacttctttcttagcaacctagcttttgtggatttctgttactcttctgtcattacacccaaaatgcttgggaatttcttgtacaaacaaaatgttatatcctttgatgcatgtgctactcaactgggctgctttctcaccttcatgatatcagaatccttgctactggcttccatggcctatgaccgatatgtggccatttgtaaccctctattgtatatggttgtaatgactccaggaatctgcattcaacttgtagcagttccttatagctatagcttcctaatggcactatttcacaccatcctcaccttccgcctctcctattgccactccaacattgtcaaccatttctattgtgatgacatgcctctcctcaggctaacttgctcagacactcgcttcaaacagctctggatctttgcctgtgctggtatcatgttcatttcctcccttctgattgtctttgtctcctacatgttcatcatttctgccatcctgaggatgcattcagctgagggaagacagaaggctttctcgacgtgtggctctcacatgctggcagtcaccatattctatgggaccctcatttttatgtacttacagcctagctctagccatgccctggacacagacaagatggcctctgtcttctacacagtgatcattcccatgttgaatcccttaatctatagcctccagaataaggaggtgaaagaagctctgaagaaaatcattatcaataaaaactag

SEQ ID NO: 4693 - DNA, 1038 bp, Homo sapiens
tgtggagcaatgccacctctcttttaatctctgggcttcaaaacaagcagaatcaaggactaaatgatggacaaccactctagtgccactgaattccaccttctaggcttccctgggtcccaaggactacaccacattctttttgctatattctttttcttctatttagtgacattaatgggaaacacggtcatcattgtgattgtctgtgtggataaacgtctgcagtcccccatgtatttcttcctcagccacctctctaccctggagatcctggtcacaaccataattgtccccatgatgctttggggattgctcttcctgggatgcagacagtatctttctctacatgtatcgctcaacttttcctgtgggaccatggagtttgcattacttggagtgatggctgtggaccgttatgtggctgtgtgtaaccctttgaggtacaacatcattatgaacagcagtacctgtatttgggtggtaatagtgtcatgggtgtttggatttctttctgaaatctggcccatctatgccacatttcagtttaccttccgcaaatcaaattcattagaccatttttactgtgaccgagggcaattgctcaaactgtcctgcgataacactcttctcacagagtttatccttttcttaatggctgtttttattctcattggttctttgatccctacgattgtctcctacacctacattatctccaccatcctcaagatcccgtcagcctctggccggaggaaagccttctccacttttgcctcccacttcacctgtgttgtgattggctatggcagctgcttgtttctctacgtgaaacccaagcaaacacagggagttgagtacaataagatagtttccctgttggtttctgtgttaacccccttcctgaatcctttcatctttactcttcggaatgacaaagtcaaagaggccctccgagatgggatgaaacgctgctgtcaactcctgaaagattagctgttctgtaagtcagttttaggtggtccaagcctcagggtt

SEQ ID NO: 4694 - DNA, 1093 bp, Homo sapiens
gcggttgttctctctcttttgctctctagatttcacaaggaacaagggcttagaactaaatgttgatgaattactctagtgccactgaattttatctccttggcttccctggctctgaagaactacatcatatcctttttgctatattcttctttttctacttggtgacattaatgggaaacacagtcatcatcatgattgtctgtgtggataaacgtctgcagtcccccatgtatttcttcctcggccacctctctgccctggagatcctggtcacaaccataatcgtccccgtgatgctttggggattgctgctccctgggatgcagacaatatatttgtctgcctgtgttgtccagctcttcttgtaccttgctgtggggacaacagagttcgcattacttggagcaatggctgtggaccgttatgtggctgtctgtaaccctctgaggtacaacatcattatgaacagacacacctgcaactttgtggttcttgtgtcatgggtgtttgggtttctttttcaaatctggccggtctatgtcatgtttcagcttacttactgcaaatcaaatgtggtgaacaattttttttgtgaccgagggcaattgctcaaactatcctgcaataatactcttttcacggagtttatcctcttcttaatggctgtttttgttctctttggttctttgatccctacaattgtctccaacgcctacatcatctccaccattctcaagatcccgtcatcctctggccggaggaaatccttctccacttgtgcctcccacttcacctgtgttgtgattggctacggcagctgcttgtttctctacgtgaaacccaagcaaacgcaggcagctgattacaattgggtagtttccctgatggtttcagtagtaactcctttcctcaatcctttcatcttcaccctccggaatgataaagtcatagaggcccttcgggatggggtgaaacgctgctgtcaactattcaggaattagccttgctctgaggacttttacatggtaaagcacttagtatggattctagaataatctgaaaagaacttgctcatctttgaactgcatca

SEQ ID NO: 4695 - DNA, 918 bp, Homo sapiens
atgcagaggagcaatcatacagtgactgagtttatactgctgggcttcaccacagacccaggaatgcagctgggcctcttcgtggtgttcctgggcgtgtactctctcactgtggtaggaaatagcaccctcatcgtgttgatctgtaatgactcctgcctccacacacccatgtattttttcactggaaatctgtcgtttctggatctctggtattcttctgtctacaccccaaagatcctagtgacctgcatctctgaagacaaaagcatctcctttgctggctgcctgtgtcagttcttcttctctgcagggctggcctatagtgagtgctacctgctggctgccgtggcttatgaccgctacgtggccatctccaagcccctgctttatgcccaggccatgtccataaagctgtgtgcattgctggtagcagtctcatattgtggtggctttattaactcttcaatcatcaccaagaaaacgttttcctttaacttctgccgtgaaaacatcattgatgactttttctgtgatttgcttcccttggtggagctggcctgtggcgagaagggcggctataaaattatgatgtacttcctgctggcctccaatgtcatctgccccgcagtgctcatcctggcctcctacctctttatcatcaccagtgtcttgaggatctcctcctccaagggctacctcaaagccttctccacatgctcctcccacctgacctctgtcactttatactatggctccattctctacatctacgctctccccagatctagctattcttttgatatggacaaaatagtttctacattttacactgtggtattccccatgttgaatctcatgatctacagcctaaggaataaggatgtgaaagaggctctgaaaaaacttctcccataa

SEQ ID NO: 4696 - DNA, 985 bp, Homo sapiens
atgattttcccttctcatgatagtcaggctttcacctccgtggacatggaagtgggaaattgcaccatcctgactgaattcatcttgttgggtttctcagcagattcccagtggcagccgattctatttggagtgtttctgatgctctatttgataaccttgtcaggaaacatgaccttggttatcttaatccgaactgattcccacttgcatacacctatgtactttttcattggcaatctgtcttttttggatttctggtatacctctgtgtatacccccaaaatcctggccagttgtgtctcagaagataagcgcatttccttggctggatgtggggctcagctgtttttttcctgtgttgtagcctacactgaatgctatctcctggcagccatggcatatgaccgccatgcagcaatttgtaacccattgctttattcaggtaccatgtccaccgccctctgtactgggcttgttgctggctcctacataggaggatttttgaatgccatagcccatactgccaatacattccgcctgcatttttgtggtaaaaatatcattgaccactttttctgtgatgcaccaccattggtaaaaatgtcctgtacaaacaccagggtctacgaaaaagtcctgcttggtgtggtgggcttcacagtactctccagcattcttgctatcctgatttcctatgtcaacatcctcctggctatcctgagaatccactcagcttcaggaagacacaaggcattctccacctgtgcttcccacctcatctcagtcatgctcttctatggatcattgttgtttatgtattcaaggcctagttccacctactccctagagagggacaaagtagctgctctgttctacaccgtgatcaacccactgctcaaccctctcatctatagcctgagaaacaaagatatcaaagaggccttcaggaaagcaacacagactatacaaccacaaacatgaa

SEQ ID NO: 4697 - DNA, 945 bp, Homo sapiens
atggccaagaataatctcaccagagtaaccgaattcattctcatgggctttatggaccaccccaaattggagattcccctctttctggtgtttctgagtttctacctagtcacccttcttgggaatgtggggatgattatgttaatccaagtagatgtcaaactctacaccccaatgtacttcttcctgagccacctctccctgctggatgcctgttacacctcagtcatcacccctcagatcctagccacattggccacaggcaaaacggtcatctcctacggccactgtgctgcccagttctttttattcaccatctgtgcaggcacagagtgctttctgctggcagtgatggcctatgatcgctatgctgccattcgcaacccactgctctataccgtggccatgaatcccaggctctgctggagcctggtggtaggagcctatgtctgtggggtgtcaggagccatcctgcgtaccacttgcaccttcaccctctccttctgtaaggacaatcaaataaacttcttcttctgtgacctcccacccctgctgaagcttgcctgcagtgacacagcaaacatcgagattgtcatcatcttctttggcaattttgtgattttggccaatgcctccgtcatcctgatttcctatctgctcatcatcaagaccattttgaaagtgaagtcttcaggtggcagggccaagactttctccacatgtgcctctcacatcactgctgtggcccttttctttggagcccttatcttcatgtatctgcaaagtggctcaggcaaatctctggaggaagacaaagtcgtgtctgtcttctatacagtggtcatccccatgctgaaccctctgatctacagcttaagaaacaaagatgtaaaagacgccttcagaaaggtcgctaggagactccaggtgtccctgagcatgtag

SEQ ID NO: 4698 - DNA, 1122 bp, Homo sapiens
tcacagtatacttatgaggcaaaaattaataataacattaatttaaaaatagctttgtaaatcctaataccataagagattatttgtaatgctaggatccaaaccaagagttcatttgtatattttgccctgtgcctctcaacaggtttctaccatgggtgacaggggaacaagcaatcactcagaaatgactgacttcattcttgcaggcttcagggtacgcccagagctccacattctcctcttcctgctatttttgtttgtttatgccatgatccttctagggaatgttgggatgatgaccattattatgactgatcctcggctgaacacaccaatgtattttttcctaggcaatctctccttcattgatcttttctattcatctgttattgaacccaaggctatgatcaacttctggtctgaaaacaagtctatctcctttgcaggctgtgtggcccagctctttctctttgccctcctcattgtgactgagggatttctcctggcggccatggcttatgaccgctttattgccatctgcaaccctctgctctactctgttcaaatgtccacacgtctgtgtactcagttggtggctggttcctatttttgtggctgcattagctcagttattcagactagcatgacatttactttatctttttgcgcttctcgggctgttgaccacttttactgtgattctcgcccacttcagagactgtcttgttctgatctctttatccatagaatgatatctttttccttatcatgtattattatcttgcctactatcatagtcattatagtatcttacatgtatattgtgtccacagttctaaagatacattctactgagggacataagaaggccttctccacctgcagctctcacctgggagttgtgagtgtgctgtatggtgctgtcttttttatgtatctcactcctgacagatttcctgagctgagtaaagtggcatccttatgttactccctagtcactcccatgttgaatcctttgatttactctctgaggaacaaagatgtccaagaggctctaaaaaaatttctagagaagaaaaatattattctttgattattatttctctttcaccaatttta

SEQ ID NO: 4699 - DNA, 2488 bp, Homo sapiens
ggtggcccttgtgcagggaattgaagaagtgcaggaggatgccacacagagatggtagagggagcgaaaggagcaaaggccctaactttcccttaatgatgtctccttccatctttagtccagcccagcaatgtacatgttatccttcccgtttgaagatgaagacactgaggctcagaaagatcaaacgcctttcccaaactcacagctacggcctgacggagccatgtaagcaccaagaagacccttaccagacactgcatgctggtgccttgatcttggacttcccagcctcctgaactggaccactggtgtcatggcagagatgaacctcaccttggtgaccgagttcctccttattgcattcactgaatatcctgaatgggcactccctctcttcctcttgtttttatttatgtatctcatcaccgtattggggaacttagagatgattattctgatcctcatggatcaccagctccacgctccaatgtatttccttctgagtcacctcgctttcatggacgtctgctactcatctatcactgtcccccagatgctggcagtgctgctggagcatggggcagctttatcttacacacgctgtgctgctcagttctttctgttcaccttctttggttccatcgactgctacctcttggccctcatggcctatgaccgctacttggctgtgtgccagcccctgctttatgtcaccatcctgacacagcaggcccgcttgagtcttgtggctggggcttacgttgctggtctcatcagtgccttggtgcggacagtctcagccttcactctctccttctgtggaaccagtgagattgactttattttctgtgacctccctcctctgttaaagttgacctgtggggagagctacactcaagaagtgctgattattatgtttgccatttttgtcatccctgcttccatggtggtgatcttggtgtcctacctgtttatcatcgtggccatcatggggatccctgctggaagccaggccaagaccttctccacctgcacctcccacctcactgctgtgtcactcttctttggtaccctcatcttcatgtacttgagaggtaactcagatcagtcttcggagaagaatcgggtagtgtctgtgctttacacagaggtcatccccatgttgaatcccctcatctacagcctgaggaacaaggaagtgaaggaggccctgagaaaaattctcaatagagccaagttgtcctaaccatctccaaacttggaaaatcccgagaaccacctactctgtagtgtcagaattctggacgctcattatttatagcatgctcaatgtttaaatgaatatattatggtactaggtataaaaaagaaccagaacttttagctccagggagaggaaggaagacaaggaaaagtcaacctgaaaagagattggagtgggagttttgattcccaggacaagtgacaaaaggatttgaaattaaagcctgtgcaatccaaatatggcacacttcacctgtctgtgattataagagtaattttttttgcaaaatttttaatgaaagattttcatcatatagaaatgttaaaaataatatgtaggaagtttcctatactcagtactgagattgtgtaattgctaatatttgctgtctttacttggttacatagatgtaatctatccgtgagtttattcatcaatcaattcactcatcaaaccacctttttttgattcatttcaaggtgagttccggacatcagcattagtaccctttacttctatgcacttcagaattatatcatcaattaggattcaatatttagattacatttatttttaatgatcaaactatggtcgtttgatgatccaattagcaaagctgaccctactcaaggtatgccttaatattctggtagtagttctcaagaaggcctcacacaaacttttaacaatgcctacaataacatgtctgtcaattgctatcacctctggatatatgccctgttctttttcttcctacctattacagttctctctcgtcatatggcatgactaaaaatccacttagcaaagttataccattcccactgcccataatggcgtcttcagtgtctgtatcatagacattgactctctgtgttctgaaagctttttccttcagggaggcagaacattgctgcattccacatggcgataggcaggagggtggtcctcgcctatcctgggtccctgcactctgcagcagctcagcctgcatccaaagcctcacaaaatctgtctgttcttaatctttacttctctaatcacaggggacttgtctcaatcaaacccaaggcactggaagagagcaggccccatctattaattttttttcatttaaacaaatttttatacctggaactcaaacttcttttcctgtctcctggattactaaaaaaaaaaaaaaaaaaaaaaatccaaaaccaaaacaacaacaacaaaaaa

SEQ ID NO: 4700 - DNA, 1085 bp, Homo sapiens
tgagctgtcccctcatctggctcttgtcttagccgttgcaggtgaaccactggatggatggctgaaaggaattacaccgtagtgacggagttcttccttactgcatttactgaacatctccagtggagggttcctctcttcctcatatttttgagtttctatcttgccactatgttagggaacacaggcatgatcctcctgatccgtggcgatcgtcggctccacaccccgatgtacttcttcctcagccacctttccttggtggacatctgctactcgtccgccatcatccctcagatgctggctgtgctgtgggagcacggcacaaccatctcccaggctcgctgtgcagctcagttcttcctcttcaccttctttgcctccatcgactgctaccttctggccatcatggcctatgaccgctacacggccgtgtgccagcccctgctttatgtcaccatcataaccgagaaggcccgctggggcctagtcactggggcttacgttgctggttttttcagtgcctttgttcgaacggtcacagccttcactctctccttttgtggaaacaatgagatcaacttcattttctgtgacctccctcctctattaaaactctcctgtggggacagctacactcaggaagtggtgattattgtgtttgctcttttcgtcatgcctgcctgtatcttggtgatcttggtatcctacctgtttatcattgtggccatcctgcagatccactctgctggaggccgggccaagaccttctccacctgcgcctcccacctcactgccgtcgctcttttctttggcaccctcatcttcatgtacctgcgagacaacacaggccagtcctccgagggagaccgagtggtgtctgtgctctacacggtggtgaccccaatgctgaatccccttatctatagcctgagaaacaaggaggtaaaagaggccactaggaaagccctgagcaaatcaaagcctgctagaagaccctaaatggacccttgtgaaatatatcattccttagtttccccatcttttctgtcttttctcaatagcaccttctggagagactttcc

SEQ ID NO: 4701 - DNA, 3557 bp, Homo sapiens
ccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaa

SEQ ID NO: 4702 - DNA, 1411 bp, Homo sapiens
atgaaagacacaagccaataaagccagtgagaaaggagcttaccaaaggcagtgtacgaagaaggttcctgggagactgtcagaaatgagtttttcactgaacttcaccctgccggcgaacacagactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatctt

SEQ ID NO: 4703 - DNA, 3521 bp, Homo sapiens
aatgtggactcccgtcagctggggatggagtggccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaa

SEQ ID NO: 4704 - DNA, 3629 bp, Homo sapiens
aatgtggactcccgtcagctggggatggagtggccagcctcagcctcatgtaacccattgtttccaaagggctgcaggctgcagaagcccccaagctctcaggccagctgtggcttctttgctgagatggaggtatagccaagaaagcagcctgaaaagtaaggacagaaaatcaaggcaaagagggtgggtgaaccaggccatacacgtcggccatgcagcagcagcccatctttcccgagggatggactgagggcttggctactcccctgaccataaatggcttggccagggttctcttggagccacctctcagcctgcctctgcagctttgtcagttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacacactgaaagtcctgggcagctctctggacaatgcggatgacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcttcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccttttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaa

SEQ ID NO: 4705 - DNA, 1047 bp, Homo sapiens
agtgcagcgaccatccagtgtccttgcagcacgtgttggtctggtgctagcgtgaagagcagtggttaggtcccttgagcaagaggaccctgacctaagaggcccagacgtccctgtgttccaccgtcatcccagaagcagagagtttttcactgaacttcaccctgccggcgaacacacactgaaagtcctgggcagctctctggacaatgcggatgacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgaga

SEQ ID NO: 4706 - DNA, 1077 bp, Homo sapiens
ttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaa

SEQ ID NO: 4707 - DNA, 663 bp, Homo sapiens
gccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccacggagtctcgctctgttgcccaggctggagtgcagtggcgtgatctcggctcactacaaactctgcctcccaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaa

SEQ ID NO: 4708 - DNA, 1555 bp, Homo sapiens
gtatggcgggcaggaagtgcgggtgcgcgcctgcgcataggtcgggtctgcggtgtcaccgctttcgcttctgcttgagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcagcttgtccgggaagagaagtttattgaacagccagaacagattgcagagttaacgctcaacagcttcatccagaacacagaaatctgtcggagttga

SEQ ID NO: 4709 - DNA, 1935 bp, Homo sapiens
agcgaagggcgccccggccggtatggcgggcaggaagtgcgggtgcgcgcctgcgcataggtcgggtctgcggtgtcaccgctttcgcttctgcttgagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 4710 - DNA, 852 bp, Homo sapiens
gtgcgcgcctgcgcataggtcgggtctgcggtgtcaccgctttcgcttctgcttgagtcagtcctcacggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaa

SEQ ID NO: 4711 - DNA, 2103 bp, Homo sapiens
gttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcagcttgtccgggaagagaagtttattgaacagccagaacagattgcagagttaacgctcaacagcttcatccagaacacagaaatctgtcggagttgaaatgtgaaggaaacgcaggctaggaagacacaccagtcttgggaagatgaataaatgaaagaaggtcagccaggcggaatgtttctgcttcatctctgctcatatacagtgtagcggccatggaggggtaccactcagatcactcttcaagtgagtcctctgtggcatgcatgactgacaaatgctccagctgtcacaccttcaggcccatggtaactgaatatagcaggggcactagagctgggccgttcctgctgcacatgagatggtgtcatggatgactattgcatgaggactccctgttgacctggccaaaactttcttagaactgcactgtagtcacagctcttcctacttcctcctccttctttcccactctcctttctcgcacttcagactcacatcatggtctgaaggctctctctgcctcctcctgatcctctcctttgtcatgcaccagagcttctccaatacatctcatgcacagctaatcccatcttggtgtctacttcctgaagaatgctaatgcaaagacacagtgactctgtttttcagcccacatgtctctcacctgggaaacagatcaattctatgatatcatcatgcaatggaatactatagggcagtcaaaatgaacgaattagagatataggcatcaacatacatacatctcaaaaagataatgttgagcaaaaacaaaaatgttgcagagtgatacatacagtatgtaacatttatacaaagttttaaaacttgtgaaacaatgtcatatataatttgtagatgagtacatatgtgacaaaagcataaaaacacactaagggctgggtgcggtggctcgcgcctgtaatcccagcactttgggaggccaaggtgggtggatcatgaggtcaagagattgagaccatcctggccaacatggtgaaatcccgtctctactaaaaatacaaaaatcagctgaatgtggtggcacatgcctgcagtaccagctacttgggaggctaaggcagaagaatcacttgaaccccggaggcagaggttgcagtgagctgagatcgcgccattgcactccaccctgagcacagagagagactccatctcaaaacaaacaaacaaac

SEQ ID NO: 4712 - DNA, 836 bp, Homo sapiens
ggagcgaagggcgccccggccggtatggcgggcaggaagtgcgggtgcgcgcctgcgcataggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgct

SEQ ID NO: 4713 - DNA, 744 bp, Homo sapiens
gcttctgcttgagtcagtcctcacgctactcatggatgtctttttaagaatgcatacagttctcattctgttgcccacgccggagtgtagtggcacaattttggctcactgcagtctcttgcctcccaggttcaagtgattctcctgcctcagcctcccaagtagctgggtttacaggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagt

SEQ ID NO: 4714 - DNA, 1036 bp, Homo sapiens
ttgagtcagtcctcacggtgacgcttttccccagcttttccgagtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctggg

SEQ ID NO: 4715 - DNA, 3605 bp, Homo sapiens
agtcgcctcccagatgagcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagatcacaaaggcatcaaggaagaggctcacggtaagcctggcctactcggagagccaccagatccgcgtgtcccagcaggacttccggctcttccgcaccctcttcctcctcatggtctccttcttcatcatgtggagccccatcatcatcaccatcctcctcatcctgatccagaacttcaagcaagacctggtcatctggccgtccctcttcttctgggtggtggccttcacatttgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatcttaaaaaaaaaaaaaaaaagatttgttatgggttccttttaaatgtgaacttttttagtgtgtttgtaatatgatcaaatttaataaatatttatttatgactgttcagcaatcacatctcctacatataaagccacaccatagtggtttctgaagtgagtcttagaaccgattcaggacgcagatttctcctctgaagggtcacagccaccctgtgccctaccttggactcgcaagggtttaggatcattcgttgatgtcaagagcaattgaagaatttctaaggaacagttaaagatgacttacttttttttttttttcatttataaaaatgctatggacccttttaagagaatcggcatcatgaaatgagagagaaagtaggatggctctgaaatgtttgagagtgagttcaggagtggtttactcctgacgcatccagcagagatgcctcttaagcaccagccatggcagacagtgtcctttgtgctaggaatacagtggtgaaccagacagccatggccctctctcagggaacttaccttcgagtcaggggcagaaaaactaaataaaagtcaataaactatatctatatacagatacctatatatttgagatgagggtcttgctccaatgcccaggctggagtgcaacggcacaatcacggctccctgaagcctcaaatgccttggctcaagcaatcctcccgcctcagcctcccaagtagctgggattacaggcgtgagccgccacgcctggctacaagtcaataaatagtatagcatcacagagcgaataagcactgtgaagaaaatgggacgggggctatggtagtgatgggaatttagatcagatggggaggggcctaaggagacctttctgaggagtgacaaattggatcaaaaggtaagcgacaagaaagggccacctgtgtgaatgggggaagggacacagaagagatgttagtgcaaggaggctgacacgcttgaagggagagtggcgtaagccgactattgatggagcctcctctgcactaggcactgcctttaatgctgagatgaggggtacccggctggggcctgtcagttgaggccagagaaattgcagggttagatcacatagggcctaggagtttattctgttctccaagcccctggaggttggcaactggaggctgacgtgacctgatgaatgtgtgcaaagattaccctggctgctgggcagggaatagactctgaggagcatgagtgaaaatggagaccagttgggcagctgctgaagtgtgacatggggatgggaccttggaggtgagtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtga

SEQ ID NO: 4716 - DNA, 3653 bp, Homo sapiens
agtcgcctcccagatgagcactctctcagaccgctgcgggccgccaggcgccgggaatgtcccctgaatgcgcgcgggcagcgggcgacgcgcccttgcgcagcctggagcaagccaaccgcacccgctttcccttcttctccgacgtcaagggcgaccaccggctggtgctggccgcggtggagacaaccgtgctggtgctcatctttgcagtgtcgctgctgggcaacgtgtgcgccctggtgctggtggcgcgccgacgacgccgcggcgcgactgcctgcctggtactcaacctcttctgcgcggacctgctcttcatcagcgctatccctctggtgctggccgtgcgctggactgaggcctggctgctgggccccgttgcctgccacctgctcttctacgtgatgaccctgagcggcagcgtcaccatcctcacgctggccgcggtcagcctggagcgcatggtgtgcatcgtgcacctgcagcgcggcgtgcggggtcctgggcggcgggcgcgggcagtgctgctggcgctcatctggggctattcggcggtcgccgctctgcctctctgcgtcttcttccgagtcgtcccgcaacggctccccggcgccgaccaggaaatttcgatttgcacactgatttggcccaccattcctggagagatctcgtgggatgtctcttttgttactttgaacttcttggtgccaggactggtcattgtgatcagttactccaaaattttacagacctcggaacacctcctggatgcaagagctgtcgtgactcacagtgagatcacaaaggcatcaaggaagaggctcacggtaagcctggcctactcggagagccaccagatccgcgtgtcccagcaggacttccggctcttccgcaccctcttcctcctcatggtctccttcttcatcatgtggagccccatcatcatcaccatcctcctcatcctgatccagaacttcaagcaagacctggtcatctggccgtccctcttcttctgggtggtggccttcacatttgctaattcagccctaaaccccatcctctacaacatgacactgtgcaggaatgagtggaagaaaattttttgctgcttctggttcccagaaaagggagccattttaacagacacatctgtcaaaagaaatgacttgtcgattatttctggctaatttttctttatagccgagtttctcacacctggcgagctgtggcatgcttttaaacagagttcatttccagtaccctccatcagtgcaccctgctttaagaaaatgaacctatgcaaatagacatccacagcgtcggtaaattaaggggtgatcaccaagtttcataatattttccctttataaaaggatttgttggccaggtgcagtggttcatgcctgtaatcccagcagtttgggaggctgaggtgggtggatcacctgaggtcaggagttcgagaccaacctgaccaacatggtgagacccccgtctctactaaaaataaaaaaaaaaattagctgggagtggtggtgggcacctgtaatcctagctacttgggaggctgaaccaggagaatctcttgaacctgggaggcagaggttgcagtgagccgagatcgtgccattgcactccaaccagggcaacaagagtgaaactccatcttaaaaaaaaaaaaaaaaagatttgttatgggttccttttaaatgtgaacttttttagtgtgtttgtaatatgatcaaatttaataaatatttatttatgactgttcagcaatcacatctcctacatataaagccacaccatagtggtttctgaagtgagtcttagaaccgattcaggacgcagatttctcctctgaagggtcacagccaccctgtgccctaccttggactcgcaagggtttaggatcattcgttgatgtcaagagcaattgaagaatttctaaggaacagttaaagatgacttacttttttttttttttcatttataaaaatgctatggacccttttaagagaatcggcatcatgaaatgagagagaaagtaggatggctctgaaatgtttgagagtgagttcaggagtggtttactcctgacgcatccagcagagatgcctcttaagcaccagccatggcagacagtgtcctttgtgctaggaatacagtggtgaaccagacagccatggccctctctcagggaacttaccttcgagtcaggggcagaaaaactaaataaaagtcaataaactatatctatatacagatacctatatatttgagatgagggtcttgctccaatgcccaggctggagtgcaacggcacaatcacggctccctgaagcctcaaatgccttggctcaagcaatcctcccgcctcagcctcccaagtagctgggattacaggcgtgagccgccacgcctggctacaagtcaataaatagtatagcatcacagagcgaataagcactgtgaagaaaatgggacgggggctatggtagtgatgggaatttagatcagatggggaggggcctaaggagacctttctgaggagtgacaaattggatcaaaaggtaagcgacaagaaagggccacctgtgtgaatgggggaagggacacagaagagatgttagtgcaaggaggctgacacgcttgaagggagagtggcgtaagccgactattgatggagcctcctctgcactaggcactgcctttaatgctgagatgaggggtacccggctggggcctgtcagttgaggccagagaaattgcagggttagatcacatagggcctaggagtttattctgttctccaagcccctggaggttggcaactggaggctgacgtgacctgatgaatgtgtgcaaagattaccctggctgctgggcagggaatagactctgaggagcatgagtgaaaatggagaccagttgggcagctgctgaagtgtgacatggggatgggaccttggaggtgagtggcattagggagggattgtgagaaatgacttgtaaatataccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccaagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtga

SEQ ID NO: 4717 - DNA, 3321 bp, Homo sapiens
acggagccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcggcttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 4718 - DNA, 3369 bp, Homo sapiens
cgaccaggtggggcgggtcgtggcggggggcagggtcccctccggagggccctgggttagagtctgggcgtggacgcgcccctcataggggtcattggggcatagaggcatagagccggcttctccagcttgggattcacgtgtttttcaagggctaacggaaatgctgagatctaaaagcatgtttattgctgccaaggcctgacgatgaaacttcaagtcaaattacttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 4719 - DNA, 3147 bp, Homo sapiens
ggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaa

SEQ ID NO: 4720 - DNA, 592 bp, Homo sapiens
atcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaatttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgc

SEQ ID NO: 4721 - DNA, 1261 bp, Homo sapiens
cgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccctacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 4722 - DNA, 2308 bp, Homo sapiens
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcaggagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 4723 - DNA, 2401 bp, Homo sapiens
ataactgcgacactcactcatttgcgcttcaccagacacagagcaaccgccagccccaagagcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaccaaggggctgatccccagccaggaccccaggatgtaggacgcccactggctctccctttcttctgagacacatccagcccccccacgtctccctcatatacacagacccaggattatgctgtgagcctgcaggctttggaagtggccctgtcacccgtgctgcacgggattcacagccccagccccatggcccctctccacacctcaaaactcctgccccataacgtcctccgcatccactttccagctcagcagccgcacccgaggctcagcctgaggggtatgtgcccaggccctcccacttcccgagttgtctgcctctcctcaaatgctgtgtgctgcaattgtccaggcgatgacaatggtgatggctccagagaacacaccagctatttatgagcctctgcccccaggctgggcctgtcactggcataggaaggccagccccgcatctcccactgccaacagctgaagccgagcacagacctccctttgcacgctggaacagttactcacctgtggcttcttcccccagtgtaccgttccactgtggcccacattcttgtgcacgcgggcatttgcaggcacgctctcgcgtagttacctatctgaatgcacaccaagcacatgcgtgcacactctgcgtctgtgattcatttcatgtagtggtctaagctcctcccagggctgtgtggatctgacagggtataggaaaataaaaagcggagaaggtgtcttcag

SEQ ID NO: 4724 - DNA, 1653 bp, Homo sapiens
agcagctccaggctggatctgcgccggacacaggagaaagcagcgggtaggctaagcaggggtgctgaggatggaggaaagttgggaggctgagcacagctgaagtcctgagctccctgtgcccttgacttctctgtgggctcgagcaaggaccatcccaactcaggatgaaccctccttcggggccaagagtcccgcccagcccaacccaagagcccagctgcatggccaccccagcaccacccagctggtgggacagctcccagagcagcatctccagcctgggccggcttccatccatcagtcccacagcacctgggacttgggctgctgcctgggtccccctccccacggttgatgttccagaccatgcccactataccctgggcacagtgatcttgctggtgggactcacggggatgctgggcaacctgacggtcatctataccttctgcagagctgtgcttcgtggagtcactgtgatgatgcagagcagaagcctccggacacctgccaacatgttcattatcaacctcgcggtcagcgacttcctcatgtccttcacccaggcccctgtcttcttcaccagtagcctctataagcagtggctctttggggagacaggctgcgagttctatgccttctgtggagctctctttggcatttcctccatgatcaccctgacggccatcgccctggaccgctacctggtaatcacacgcccgctggccacctttggtgtggcgtccaagaggcgtgcggcatttgtcctgctgggcgtttggctctatgccctggcctggagtctgccacccttcttcggctggagcgcctacgtgcccgaggggttgctgacatcctgctcctgggactacatgagcttcacgccggccgtgcgtgcctacaccatgcttctctgctgcttcgtgttcttcctccctctgcttatcatcatctactgctacatcttcatcttcagggccatccgggagacaggacgggctctccagaccttcggggcctgcaagggcaatggcgagtccctgtggcagcggcagcggctgcagagcgagtgcaagatggccaagatcatgctgctggtcatcctcctcttcgtgctctcctgggctccctattccgctgtggccctggtggcctttgctgggtacgcacacgtcctgacaccctacatgagctcggtgccagccgtcatcgccaaggcctctgcaatccacaaccccatcatttacgccatcacccaccccaagtacagggtggccattgcccagcacctgccctgcctgggggtgctgctgggtgtatcacgccggcacagtcgcccctaccccagctaccgctccacccaccgctccacgctgaccagccacacctccaacctcagctggatctccatacggaggcgccaggagtccctgggctcggagagtgaggtgggctggacacacatggaggcagcagctgtgtggggagctgcccagcaagcaaatgggcggtccctctacggtcagggtctggaggacttggaagccaaggcaccccccagaccccagggacacgaagcagagactccagggaagaggcgagcttcatcaggcaggagccagaggccagagagacagcgtgcagctccag

SEQ ID NO: 4725 - DNA, 1801 bp, Homo sapiens
ttcagatccctcgtggttcgagaacagaatggcgttaaatcacactgccctgcctcaggacgagcgcctgccccattaccttcgagatggggatccttttgcttccaaactttcttgggaagcggatttagtggctggcttttacctaacaataattgggattctgtccacatttggaaatggatatgtcctttacatgtcttctagacgaaagaagaagctgagacccgctgaaataatgactatcaatttagcagtctgtgatctggggatttcagttgtaggcaagccgttcaccatcatctcttgcttttgtcaccgctgggtgtttggctggatcggctgccgctggtatggatgggctggatttttctttggctgtggaagccttatcaccatgactgctgtcagcctggatcgatatttgaaaatctgctatttatcttatggggtttggctgaaaagaaagcacgcctacatctgcctggcagccatctgggcctatgcttccttctggaccaccatgcccttggtaggtctgggggactacgtacctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtagcgatgttgatttgtgctggattcctgattgcctggattccttatgcagtggtgtctgtgtggtcagcttttggaaggccagactccattcccatacagctctctgtggtgccaaccctacttgcaaaatctgcagcgatgtacaatcccatcatttaccaagttattgattacaaatttgcctgttgccaaactggtggtttgaaagcaaccaagaagaagtctctggaaggcttcaggctgcacaccgtaaccacagtcaggaagtcttctgctgtgctggaaattcatgaagagtgggaataacaaatgttctggttgtgaagagtgcatctgaagtgcttacacggcgtctggcatatgcagagaaattagcttacaaatgttatttttctgacttctcgcctccactccacttaccctgtcaggaaaaaataattcacaaggaatatcaaaacaatgatgcaccctaggagtatccaagtatcttaactgagttatctcattctggtatagtggcagagttataactaaagagtgccagaaacccacgctttaaacatcctgcagtgcacacctcggtctcgtcagtaaggacttcactttcttctgaactggggcttgtgaaagctggcctgaaaagcctgattcaaggagatcaggctgtgtctctgactggagcagctacactccccatctgtaatttgatttgttctattgcagatgatgtactgggcagaggtgagtgtggattggtgaaaatctgtttttatgactggcaaagcagtgcaggggggtctttcactgataagaagcatcatcagtagggtttgtccctgatgcctttacaacagcatctgagcacctctcaagtttttccaggccagctccagtttcagtgaggagagtgtgggctttctattccccaaatattcttactacagttaatatgtaggttactgccccagcccaactgcaggttcccagatgtgagttccatgtaggcagaaactg

SEQ ID NO: 4726 - DNA, 1455 bp, Homo sapiens
attgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttga

SEQ ID NO: 4727 - DNA, 1136 bp, Homo sapiens
cttcccgtcacggcgttgccccagcaaccggactattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaaggggacgatttgctcgccatgatggatgagttatag

SEQ ID NO: 4728 - DNA, 767 bp, Homo sapiens
gctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgaagagagtgcttctggaagcatatgcaagaaactgttcacagtgcacagtgttgccttccaggagtggggaactatatggaggacaggagaaggagactgactttccattatgtatacccttttgagaactttgagttttgtacctgggcaaaataaaattttaaaaaggggaagaaa

SEQ ID NO: 4729 - DNA, 1463 bp, Homo sapiens
ggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaac

SEQ ID NO: 4730 - DNA, 1463 bp, Homo sapiens
agaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtacacagcagatcttctggaggtgctgaagaccaattacggcatcccctccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcgtccccgacggcatctatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaa

SEQ ID NO: 4731 - DNA, 940 bp, Homo sapiens
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatgcatctccctggaatcattccatccttgccctggcagctgtggtggtcattataagcatggtcctcctgggaagaagcatccaggcaagcagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 4732 - DNA, 1885 bp, Homo sapiens
ctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaatgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatgatttctgctgttcaaaaaagtccctaaagagacaggctcttgccatgttgcccgggctggtcctgaactgctgaattcaagtgatcctcccaccttggcctccagaagtgctgggattatgggtgtgagccaccatgcctagccaaaatgtttcttaaggtatacattttgggtcttagaagacttatacatttgtaatatttattactaaatatctcaaagtattacaataaatgttaccatgtgagctactttgaatcaggcttcttgcacaccaatttaaaaatgttaactcttgatatatacactagttataccactcatgtcagtcaataaattttaaggtttaagtgcaggcctttgtttacagaaatcctaattttttgaaaccataactctgacctgacactaaattcctgtagacatgctaaggaaaatctgcttagtatcgagatcaagaactttcattcaaaaagattattcagttatgttatttgcatattaccattattaaaaataaaaaaatttttaaaagatg

SEQ ID NO: 4733 - DNA, 914 bp, Homo sapiens
atcacttccgggcgccaggttcgggctttctcctgcagcgataagggcagtcgacagtctttagtagggaaaggagacaagtgctagctactgccgcccaagtggaaggtgggtgaaattgctcactcttcaccccactgacgcttttgcgcacctggaaaagcggttccagtttgcgcccgtcgccgccttacagccgacaggagaccagcgctacccaagtcacgaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaa

SEQ ID NO: 4734 - DNA, 874 bp, Homo sapiens
aggttcgggctttctcctgcagcgataagggcagtcgacagtctttagtagggaaaggagacaagtgctagctactgccgcccaagtggaaggtgggtgaaattgctcactcttcaccccactgacgcttttgcgcacctggaaaagcggttccagtttgcgcccgtcgccgccttacagccgacaggagaccagcgctacccaagtcacgtgggttcagcctgcagctttcttggcccgaaagggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaag

SEQ ID NO: 4735 - DNA, 1779 bp, Homo sapiens
agattccatcctatttctccgatgaaagtatcaggtacctcacccctaagtttagatttgatgatagttcccttaaaaatgaatgacgaataatctaccccatccttttctcacagtagcaaccaaattccagccaagggcaaaaaaaaaatttctttttaatgtagcttagtgtttggaacttgatgttgtgtagtcagacaaacctgtattcggcctccgctggatcagtcactagctgtgtaattttacagaactctcatcacctgcaaatctgggggaaatgcaggtgcgcacagagagcgttttgggcaaagacggcctttaagcttttcttcactaagcatgccgctcgctagcggaacagcagccagctctggacgggaccttgcacagttccgatgacatcacttccgggcgccaggttcgggctttctcctgcagcgataagggcagtcgacagtctttagtagggaaaggagacaagtgctagctactgccgcccaagtggaaggaattatctatagagtaagtatgctaatcttgactaagactgcaggagttttttttaaaccatcaaaaaggaaagtttatgaatttttaagaagttttaattttcatcctggaacactatttcttcataaaatagtattgggaattgaaactagttgtgatgatacagcagctgctgtggtggatgaaactggaaatgtgttgggagaagcaatacattcccaaactgaagttcatttaaaaacaggtgggattgttcctccagcagctcaacagcttcacagagaaaatattcaacgaatagtacaagaagctctttctgccagtggagtctctccaagtgacctctcagcaattgcaactaccataaaaccaggacttgctttaagcctgggagtgggcttatcatttagcttacagctggtaggacagttaaaaaagccattcattcccattcatcatatggaggctcatgcacttactattaggttgaccaataaagtagaatttccttttttagttcttttgatttctggaggtcactgtctgttggcattagttcaaggagtttcagattttctgcttcttggaaagtctttggacatagcaccaggtgacatgcttgacaaggtggcaagaagactttctttaataaaacatccagagtgctccaccatgagtggtgggaaagccatagaacatttggccaaacaaggaaatagatttcattttgacatcaaacctcccttgcatcatgctaaaaattgtgatttttcttttactggacttcaacacgttactgataaaataataatgaaaaaggaaaaagaggaaggtattgagaaggggcaaatcctgtcttcagcagcagacattgctgccacagtacagcacacaatggcatgtcatcttgtgaaaagaacacatcgggctattctgttttgtaagcagagagacttgttacctcaaaataatgcagtactggttgcatctggtggtgtcgcaagtaacttctatatccgcagagctctggaaattttaacaaatgcaacacagtgcactttgttgtgtcctcctcccagactatgcactgataatggcattatgattgcatggaatggtattgaaagactacgtgctggcttgggcattttacatgacatagaaggcatccgctatgaaccaaaatgtcctcttggagtagacatatcaaaagaagttggagaagcttccataaaagtaccacaattaaaaatggagatatga

SEQ ID NO: 4736 - DNA, 2147 bp, Homo sapiens
agaggagacgctcgccgtcccctgacccccagctcagcgccggctccaagcccagccagtgatccctctagccttctccagtcgcctccgccatgtccgaggagctggcccagggccccaaggagagccccccggcgccgcgtgcgggccccagggaggtgtggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgggctggtgctgtttggaatctgcaccctcatcatggatgtcttcaagaccggctactactccagtttctttgagtgccagtcagccatcaagatcctgcaccccctcatccaggctgtgtttgtcatcatccagacctactttctctgggtctctgctaaagactgcgttcacgtccacctggatctgacctggtgtggtctcatgttcacactcaccaccaacctggccatctggatggcggccgtggtggatgaatctgtgcaccaatcccactcctacagcagttctcacagcaacgccagccacgcccgtctcatctctgaccagcatgcagacaacccggtcggaggagactcctgcctctgcagcacggccgtctgccagatcttccagcaggggtacttctacctatatcccttcaacatcgagtacagcctcttcgcctccaccatgctgtatgtcatgtggaagaatgtgggtagattcctggcctccacccctggccacagccacaccccaacccctgtcagcctcttccgggagaccttttttgctggcccggttctgggcctgctgctcttcgtggtggggctggctgtcttcatcatctacgaggttcaagtgagcggggacgggagccgcaccaggcaggccctggtcatctactacagcttcaacattgtctgcttgggactcaccaccttggtcagcctgagcggctccatcatctaccgttttgaccgccgggccatggaccaccataagaaccccacgcgcactctggacgtggccctgctgatgggtgccgccctgggtcagtacgccatctcttactactccatcgtggctgtggtggcgggcacaccccaggacctgctggcagggctcaacctcacccatgcactgctcatgatcgcccagcacaccttccagaacatgtttatcatcgagagccttcaccgaggaccgcccggggctgagcctcacagtacccaccccaaggagccctgccaagacctcaccttcaccaacctggatgccctccacacgttgtccgcctgcccacccaaccccgggctggttagccccagcccttcagaccagcgggaagcagtggccatcgtctcaacccccagaagccagtggagacgccagtgcctaaaagacatttctctgtttctcctactctgcaatgtcattctgtggatcatgcctgccttcggggcccgccctcatttcagcaacacagtggaggtggatttctacggctactccctctgggcggtcatcgtcaacatctgcctccctttcggcatcttctaccgcatgcacgctgtgtccagcctgctggaggtctacgtgctgtcctgaggcctccaacagaggcatggggggcaggaagagggggctcagctcatgtgcccactcagacaccctctgggaatgaatcccagctggtgccatatgacagcccatttccttctggtcccagagtggaattttcacaaaagttatttttccaggttcaatttttaaatcacagtcaggacaggcccatccaccccagtatgaccgtggggcatgaggtgactggggaagggagacctctcctggcagcatttctaggacccaacaagatctggaggtgccggctctggttccatctctaatcccctgctgtggcctggccagtgtactgcccggagctggaaaccaataaacctgtgatttgccccc

SEQ ID NO: 4737 - DNA, 1821 bp, Homo sapiens
atgggccgcggagcccgagcggcggctgcgcagtcccgctgggggagggcgtcgcgggcatcggtctcacctggacggacgatccgctcagcgcccgcagtcggtgaagcacaggagactgaagcagccccggagaaggagaaccgagtggatgtgggggccgaggagagagcggccgccacccggccccggcagaagtcctggctggtgaggcatttctctctgctgctgcggcgggaccggcaggcccagaaggctggacaactcttctcggggctcctggccctgaatgtggtgttcctgggtggcgccttcatctgcagcatgatcttcaacaaggtggccgtcactctgggtgacgtgtggatcctgctggccacgctgaaggtcctctccctgctttggcttctctactatgtggcaagcaccacccgccgaccacacgccgtgctctaccaagatccccacgcggggcccctctgggtgcggggttccctagtgctcttcggcagctgcaccttctgcctcaacatcttccgagtgggctacgatgtgagccacatccgctgcaagtcacagctggaccttgtcttctctgtcatcgagatggtcttcatcggcgtccagacctgggtgctctggaaacactgcaaagactgtgttcgggtccagaccaacttcactaggtgtggcctgatgctgaccctggccacaaacctgctgctgtgggttctggccgttaccaatgactccatgcaccgagagatcgaagctgagcttggcatcctcatggaaaaatccacaggcaatgagaccaacacctgtctgtgcctcaatgccaccgcgtgtgaagctttccggagaggcttcctgatgctctaccccttcagcactgagtactgcctcatctgctgtgctgtgctgtttgtcatgtggaagaacgtgggccgccacgtggcaccccacatgggtgcccaccctgccaccgcacccttccacctgcacggggccatcttcgggccgctgctgggcctgctggtgctgctggcaggtgtgtgcgtctttgtgctcttccaaatcgaggccagtggccctgccattgcttgccagtacttcaccctctactatgccttctatgtggctgtgctgcccaccatgagtctggcgtgcctggcgggcacagccatacacgggctggaggagagagagctggacacggtcaagaaccctacccgcagcctggatgtggtgctgctaatgggtgctgcactgggccagatgggcatcgcctatttctccatcgtggccattgtggccaagcgcccgcatgagctgctcaaccgcctcatcctggcctactcgctgctgctcatcctgcagcacatcgctcagaacctcttcatcatcgagggcctgcaccggcgcccactctgggagacagttcccgagggcctggcaggaaagcaggaggctgagcctccccgcagaggctccttgctggagctgggccagggcctgcagcgggcctcactggcctacatccactcctacagccacctcaactggaagcggagggcactcaaggagatctcactcttcctcatcctctgcaatatcacactgtggatgatgcctgcatttggcatacacccggagtttgagaacgggctagaaaaggatttctacggctaccagatatggttcgccatcgtcaacttcggcctgcctctgggggtcttctaccgcatgcactctgtgggaggcctggtggaggtctacctgggggcctgaggctgcccacccccggcagaacctcgaagt

SEQ ID NO: 4738 - DNA, 3929 bp, Homo sapiens
ctgggaccgcggagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggagagctcctgtcctttgtggcatgattaattttttttatctctacttgagttgtcttattttttaaggctataaacttagtgaccagctggataataaaagccagctggcagacttaaatgataaactttttgcaaagacctcagtgatcaaactattttttactatactgattttctgttattaacaacgatttaattgtctcatgatgtaccatgattggtcagtatagatttttcttttgtctttaggcaaaaaaaagatatatacttatgtctaatcataggaaaatgtgatttttgagtataaaatgtgggctagctttaaattatttgacagccatctatatatcttatgtttaatgaaagtataatttaaatacaatcttaataattttactttgaaaattctttttatttaatgcctttgtttactgtaccatggcctacagtcttatttggtccatcaaagttaagtttggacatggaaaattgttaggaaaactgctttagggagttaaatatccagcatatttgctttcttgttaatgaatatcctaagtgtgtatcctgactaattgttagtttcttctcaaatgaaaccctttctgtgtcttggctgtctgccttaacgctgtaggaggcagcttcttgcttgggacaaaggcattggtgatgtgttccatgttgaatctgccttcagtgcctgggctggcttgctatggaaatgtgcttagcattgattagggggtagagagctgtttctaaatcctgcttttctactttttatttcactcatttgccagaattgttcttggcaccagcagctccttaacatatagttgttgaatgactgaaagaaagcaactaatgttttaactccttgctaagtctgagattgggaggcagtcccctagagtggatagaaagaatggtggagcctcatcccaaagctgctctgatgaaactgctagaaagcagattgtagttctttgtttagatttttaaaaatccaaaagaagtcctgactgaggccaggccattccttttatgacaagtagtcctgggcccaaggttgcctgcatagagatcacaggagggtgaagggagcctgggaagaaggacagataagtgctggagacctaggagctccagttgagattctgttctggagcggatgagagaagacaggttaccctttcttatctttgttgttgcaggcctcccagggacttgtgggcttgaacagatatgattcatgggacctgaaggtgactctagcttctgcccagttttgagttttgtcaagttttaagcagagatcatttgtcaactattttgatcccagatttgaatttggggaggaagggaggagctactgacctgatgggaatatcataatccattcaaggaaatggtcattagtacctcagaggtgaagggaatatgtgaagctctggatcactacaaggagccctgacttaccagttggccccaaagtgcccaggctgagggcataggagcatgatgagatgcaaggatgtgggattatcaaggggcacgtctactaactggtgaaggcagtctgcgggggaggacacctaaaggtatgcggaaagtacctaacccagacctctctgcattaggagtggaggtgcaaagtgagcatctccagtgcagcatgggatgggaagatagggaggtgtcgcccactgtctcggtttagccagcaccacggctggctgtgtgcctgctactgtcagagagcaagggtcatctgtcctgcccagctatgcctgccaccctgttgctgactcagtattggcagaattgctgagatgggccaggtcatcacctttgcctggagtgttcatcctttcagtgccattattctggtgctaagtgctgaagaacattttcaggtctagccgagaatgtcctcttgctcttgcctgccaggcctgtccagatctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaagga

SEQ ID NO: 4739 - DNA, 954 bp, Homo sapiens
gagtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagctgaccatatacttaatgactcctaaaatctcgtggacttctaagttttctgtttgcccagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttg

SEQ ID NO: 4740 - DNA, 1232 bp, Homo sapiens
acttaatgactcctaaaatctcgtggacttctaagttttctgtttgcccagaaagcgccatggcctgtgctgctgttatgattcctgggttgttgcggtgctctgttggagccatccgtattgaggctgcgtcactgagattgacactcagcactttgcgccaccttactctaaccagcataatgaaatccaaaaggaaaactgatcacatggagagaactgcaagtgtccttcgacgggagattgtgtcagcagctaaggtgtgtggagctgccagtgagtcaccgtcagtgaagagcctccgcttgcttgttgctgatcaagacttttcctttaaagctggccagtgggttgatttctttattccaggagtctctgtggttggtgggttttcaatatgctccagtcccagactgctagaacaagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggaaccctgcctacgccatgaggacaggcccaggctagccttcggatgatgagagacctgtggccctgctaagcagcagacgtgagagatgccatcttggagctgctagctgtggtccacccatcagcgcctgcaggcacatgctgagattagtcgatttcctaaaagttgaaggaaaaatcacccagctgacctgtttgggtta

SEQ ID NO: 4741 - DNA, 1760 bp, Homo sapiens
ggctgcagggttccccttggcctgcaaacaggaacacagggtgtttctcagtggctgcgagaatgctgatgaaaaccccaggatgttgtgtcaccgtggtggccagctgatagtgccaatcatcccactttgccctgagcactcctgcaggggtagaagactccagaaccttctctcaggcccatggcccaagcagcccatggaacttcataacctgagctctccatctccctctctctcctcctctgttctccctccctccttctctccctcaccctcctctgctccctctgcctttaccactgtgggggggtcctctggagggccctgccaccccacctcttcctcgctggtgtctgccttcctggcaccaatcctggccctggagtttgtcctgggcctggtggggaacagtttggccctcttcatcttctgcatccacacgcggccctggacctccaacacggtgttcctggtcagcctggtggccgctgacttcctcctgatcagcaacctgcccctccgcgtggactactacctcctccatgagacctggcgctttggggctgctgcctgcaaagtcaacctcttcatgctgtccaccaaccgcacggccagcgttgtcttcctcacagccatcgcactcaaccgctacctgaaggtggtgcagccccaccacgtgctgagccgtgcttccgtgggggcagctgcccgggtggccgggggactctgggtgggcatcctgctcctcaacgggcacctgctcctgagcaccttctccggcccctcctgcctcagctacagggtgggcacgaagccctcggcctcgctccgctggcaccaggcactgtacctgctggagttcttcctgccactggcgctcatcctctttgctattgtgagcattgggctcaccatccggaaccgtggtctgggcgggcaggcaggcccgcagagggccatgcgtgtgctggccatggtggtggccgtctacaccatctgcttcttgcccagcatcatctttggcatggcttccatggtggctttctggctgtccgcctgccgatccctggacctctgcacacagctcttccatggctccctggccttcacctacctcaacagtgtcctggaccccgtgctctactgcttctctagccccaacttcctccaccagagccgggccttgctgggcctcacgcggggccggcagggcccagtgagcgacgagagctcctaccaaccctccaggcagtggcgctaccgggaggcctctaggaaggcggaggccatagggaagctgaaagtgcagggcgaggtctctctggaaaaggaaggctcctcccagggctgagggccagctgcagggctgcagcgctgtgggggtaagggctgccgcgctctggcctggagggacaaggccagcacacggtgcctcaaccaactggacaagggatggcggcagaccaggggccaggccaaagcactggcaggactcaggtgggtggcagggagagaaacccacctaggcctctcagtgtgtccaggatggcattcccagaatgcaggggagagcaggatgccgggtggaggagacaggcaaggtgccgttggcacaccagctcagacaggggcctgcgcagctgcaggggacagacgccaatcactgtcacagcagagtcaccttagaaattggacagctgcatgttctgtgctctccagtttgtcccttccaatattaataaacttcccttttaaat

SEQ ID NO: 4742 - DNA, 2285 bp, Homo sapiens
aactaggctgcacaggcacgctgggcgcatgtccgcctcgccggggctgccagaatcttggaatcccaatccgtgaggttcctgggtgtgctggcatcaggacagcggtccacgaacgggtaatcctgatgaaaatcaacaaaatacacatgaagagacagcactgagagcgagttactgctcatttgattcatattgccaaactgaactctcttgttttcttgcaagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcaccatcattatgctgaacctggcctgcacagatctgctgtatctgaccagcctccccttcctgattcactactatgccagtggcgaaaactggatctttggagatttcatgtgtaagtttatccgcttcagcttccatttcaacctgtatagcagcatcctcttcctcacctgtttcagcatcttccgctactgtgtgatcattcacccaatgagctgcttttccattcacaaaactcgatgtgcagttgtagcctgtgctgtggtgtggatcatttcactggtagctgtcattccgatgaccttcttgatcacatcaaccaacaggaccaacagatcagcctgtctcgacctcaccagttcggatgaactcaatactattaagtggtacaacctgattttgactgcaactactttctgcctccccttggtgatagtgacactttgctataccacgattatccacactctgacccatggactgcaaactgacagctgccttaagcagaaagcacgaaggctaaccattctgctactccttgcattttacgtatgttttttacccttccatatcttgagggtcattcggatcgaatctcgcctgctttcaatcagttgttccattgagaatcagatccatgaagcttacatcgtttctagaccattagctgctctgaacacctttggtaacctgttactatatgtggtggtcagcgacaactttcagcaggctgtctgctcaacagtgagatgcaaagtaagcgggaaccttgagcaagcaaagaaaattagttactcaaacaacccttgaaatatttcatttacttaaccaaaaacaaatacttgctgatactttacctagcatcctaagatgttcaggatgtctccctcaatggaactcctggtaaatactgtgtattcaagtaatcatgtgccaaagccagggcagagcttctagttctttgcaatccctttattgagctcctccactggggagatataagaatgggatgcatgtatatcagcaaagtattcagacatagtattacaagctattggaactcagaggcatcttagagaacatctgttcccaccaacttactatatatacacggaaaccaatttcttacccttgccctagattgctcagtaaatttgtgccaagataggagaaaaccaatcttttcactcatcatttcatgcttctctgcactctgggcctatttgtattgaaccattagacaattcaaaccactacttgtatctttcttaatatttattttttacatctcagagctctacaatttgtttccttcaagcttaactttgagattataaaactgggtttagccagttctgtatattacttcaagccagtaagatacccttgaaataatccaaggacgtccatgcaaatagttgaaattagtacctgcaatatatttggagtattatgtctttattgttgttaaaaagtttttattgaatgtatgaaaattatcaaattgtattcatcattattaacatgtcctggggaaggaagggaaactttctaggacagaagtcactttcagatgtcatgtatgtattgggtgttcaatcatatctaacactgttttgatttttgtgggaaaatattccaggaaacgctaattctctttagactccttgttcttttatgactacaatgaacatatgtctatgtgatagctaaagatatttttgaattgtatgtgtgcttaattatcggtaagtataaatatttgagaaaacacatggtctggatatttaaaaccctcataaacatgttggtacagttaataaacttatttataatt

SEQ ID NO: 4743 - DNA, 643 bp, Homo sapiens
ggatgctgctggccaggctgctcggggcgaggacccgagaacacgcacttgctcgctgggcctcggaggggtgggaggggcggggcggtgcgcagcctccccgggacaggtctgcggtccgggaccaactaggctgcacaggcacgctgggcgcatgtccgcctcgccggggctgccagaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagcgagttactgctcatttgattcatattgccaaactgaactctcttgttttcttgcaagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatga

SEQ ID NO: 4744 - DNA, 588 bp, Homo sapiens
agagcgagactccttctcaaaagaaaaaaaaaaaaaagaggcactgggctgtaggagagtggtgaaatttctggaccaagacaaggcggccacaaccctcctggggcaacaaccctcccgccgggctggttttttggaacctctgcaaacactttctcctggaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcacc

SEQ ID NO: 4745 - DNA, 1305 bp, Homo sapiens
aggtctgcggtccgggaccaactaggctgcacaggcacgctgggcgcatgtccgcctcgccggggctgccagaatcttggaatcccaatccgtgaggttcctgggtgtgctggcatcaggacagcggtccacgaacggtgtgttacccaaatattgacatcctgcagctagcctcaaacaatcacagctactttccaatttcagagaaaaaaaggctaaaattggtaatcctgatgaaaatcaacaaaatacacatgaagagacagcactgagagatgaaaggagacaaccatgaatgagccactagactatttagcaaatgcttctgatttccccgattatgcagctgcttttggaaattgcactgatgaaaacatcccactcaagatgcactacctccctgttatttatggcattatcttcctcgtgggatttccaggcaatgcagtagtgatatccacttacattttcaaaatgagaccttggaagagcagcaccatcattatgctgaacctggcctgcacagatctgctgtatctgaccagcctccccttcctgattcactactatgccagtggcgaaaactggatctttggagatttcatgtgtaagtttatccgcttcagcttccatttcaacctgtatagcagcatcctcttcctcacctgtttcagcatcttccgctactgtgtgatcattcacccaatgagctgcttttccattcacaaaactcgatgtgcagttgtagcctgtgctgtggtgtggatcatttcactggtagctgtcattccgatgaccttcttgatcacatcaaccaacaggaccaacagatcagcctgtctcgacctcaccagttcggatgaactcaatactattaagtggtacaacctgattttgactgcaactactttctgcctccccttggtgatagtgacactttgctataccacgattatccacactctgacccatggactgcaaactgacagctgccttaagcagaaagcacgaaggctaaccattctgctactccttgcattttacgtatgttttttacccttccatatcttgagggtcattcggatcgaatctcgcctgctttcaatcagttgttccattgagaatcagatccatgaagcttacatcgtttctagaccattagctgctctgaacacctttggtaacctgttactatatgtggtggtcagcgacaactttcagcaggctgtctgctcaacagtgagatgcaaagtaagcgggaaccttgagcaagcaaagaaaattagttactcaaacaacccttga

SEQ ID NO: 4746 - DNA, 3704 bp, Homo sapiens
acggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagaga

SEQ ID NO: 4747 - DNA, 3588 bp, Homo sapiens
gagtctcaggggcgcgcgcccgtgggcggctgcgtcacgtgacccaggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagag

SEQ ID NO: 4748 - DNA, 3383 bp, Homo sapiens
gagtctcaggggcgcgcgcccgtgggcggctgcgtcacgtgacccaggtaattggcacggcgcgcgcgcaccccttccgcgcagccccctgacctgcagcctccggacctcgctgcagcgcggacccggcccgcccgcccgatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctctctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacctgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaggagaggggctgtggggccccaggataaaacagacacagtgacagggccaagagccagcactgctggccttggtgtcatgccagaatctaccaggactgagggagccagaggagtcctataggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtgtgaaatgcagccacagctcatgtgtaccaaagtagaaaaccaaatcacagagaaataaaaacatgcttcagag

SEQ ID NO: 4749 - DNA, 4500 bp, Homo sapiens
agttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 4750 - DNA, 4613 bp, Homo sapiens
ggcgctgggagcgctgtagcagctgagaaggggctgaggcaccgccgcttcgctgacagccggccaccaggtttctgtctcccagtataatcatatccagccccatggctcttactggggcctctgaaatgtttatcaccaaatctgtgtctgcagttccaacctcttccctgagcatcaaagctgtatttccaactttcgctggatgcttctatctggaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 4751 - DNA, 4780 bp, Homo sapiens
cgaaaacccggagcagctgcgtacgctcatggacagtcctccgaggggcgaagccgggcagctgggcatgctcagtagctgggggaggtttgggtggagagtagaaagctgtggctctgcctctcaccccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccagatgttcatgcattctagagaaagtggaaaacttagaagcctaattaatgactgtcttctggacctctgagaccatgtttctagtgttttccgtggaatattatcagaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 4752 - DNA, 2593 bp, Homo sapiens
ggagcagctgcgtacgctcatggacagtcctccgaggggcgaagccgggcagctgggcatgctcagtagtagttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccgggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggc

SEQ ID NO: 4753 - DNA, 2769 bp, Homo sapiens
gggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagacaaa

SEQ ID NO: 4754 - DNA, 2750 bp, Homo sapiens
ggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataa

SEQ ID NO: 4755 - DNA, 3051 bp, Homo sapiens
atgcaccacctcctggagcagtcggcggacatggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctgtacgaggcccgggaggaggaggacgggggcccccgcctgccgcaggacgtgggggacctcatcgccatccctgccccacagcagatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttatttttttagtccgtttcgtcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataatc

SEQ ID NO: 4756 - DNA, 2239 bp, Homo sapiens
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagggtggacgctcttctctggctcctgggattggctgtgaggacaaaacataaaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctgtacgaggcccgggaggaggaggacgggggcccccgcctgccgcaggacgtgggggacctcatcgccatccctgccccacagcagatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttattttt

SEQ ID NO: 4757 - DNA, 1667 bp, Homo sapiens
ccgtctcctcattccaccatcccaggacccctgctgccacctctgcacccccaagctcagcagcatcatgtcacttgcacacacagctgcagagtacatgctctcagatgccctgctgcctgaccgcaggggaccccgcctcaaaggactgcgtctggaactgcccctggaccggatagtcaagttcgtagctgtgggctcccccttgttgctgatgtccctggcattcgcccaggagttctcctctgggtctccgatcagctgcttctctcccagtaacttcagcatccggcaggcagcctacgtggacagctcctgctgggactcactgcttcaccataagcaggacgggcctggccaggacaaaatgaaatctctctggccccacaaggccctcccctactccctgctggccctggccttgctcatgtacctgccggtgctgctgtggcagtatgcagctgtgccagccctcagctccgatctgctgttcatcatcagcgaactggacaaatcttataatcgctccatccgcctcgtgcagcacatgctgaagatccggcagaagagttccgacccctatgtgttctggaatgagctggagaaggctcggaaagaacgatactttgaattccctttgctagagcggtacctggcatgtaagcagcgttcacattcgctagtggctacctacctcctgaggaactccctcttgctcatcttcacctccgccacttacctataccttggtcatttccatctggatgtcttcttccaggaagaattcagctgctccatcaagacagggctgctaagtgatgagacccatgtccccaatctgatcacatgcaggctgacatcactgtccattttccagattgttagcctctccagtgtagcaatatacaccatattggttccagtgataatatacaacctcacacggctatgtcggtgggacaaacgacttttatctgtctatgagatgctcccagcttttgatctcctcagcagaaagatgctaggatgtcccatcaatgacctcaatgtgatccttcttttcctccgagctaacatctctgagctcatctcttttagctggctgagtgtcttatgtgtgttgaaggatacaaccacccagaagcacaatattgacacagtagttgattttatgactttattggctggcttagaaccctcaaaacccaaacacctcaccaactcggcatgtgatgaacacccatagttaagaaaccatggagcaagaaagcttgtggaaagtctctctccttcctcataagacatgcacactaatacacatacacaccaaaaaattacacattttaaaactgctaagcttggatttaactgaatcatatatcttttatcatgttatcctaaaagtgagaagacataaccaagacatggaaataaatgtgaaagctggagccgaagagtcaaagagctaaaaaattaagtctagaacattctatgaggatagtataaataaaaagaaatacagtctagacatgctgcaaggaaagaagattctaaagtccgtttatggaggcaattccatatcctttcttgaacgcacattcagcttaccccagagagcaagtgaggcaatctggcaaaagattaataaagatgtaaacccctggaaa

SEQ ID NO: 4758 - DNA, 2447 bp, Homo sapiens
aaactggactgtgcagtgtggttctgagtgcagtctttataaagcccagtgctgtactggtaaatataaacattttataacgtgaaaagcacaacgacacaatatgtccccttaatagctggaaaaaccaatataagccctcccactccctactaccactgattgccaccaaacaaataaacaaaatgcccaccccacccaacaacaacaataacacatcaagggggaaaatgtcatatttcctggacctaccacaatgtacagaaaataacagacagtgttatcaaatcccactctatgtcttctagggaaatctttatgtttgtgtctacctactgaggctgtagaataaacaatttcctttaggaaacataaaaataggttttttattcttagtttttaatcatgcatttttatttccttttaatctctttgtcttctattatctctatctgtacagctttgtcaccatttttttttattttctcacttgaagtagttccagaaaaaaacacaaaacctcaaaactgttaacttgaccttataatttcctttctctttctttctttctttctttttctttctttcacacaggtaagacctataacaacaaattgacaattacaaccaagttaaatcgaacctggaagggaggtagctgaaatctgtctcaaagaattattttcaacaaatagtatttaagcattggccaggatgggaataagaccaagagaaccgtctaggcagtgactcaatgtgttgaagccaggagtggcagctgataccctgcattttcaaagccctaccatctatgacaatctttcccttccttaacaccccaattcaccatcaaaactcatttcccaaggactgtatttccttaaaaggttgttggcacagaatctgggggtaatgcaaatcctttgggtaggtagttaagattgtggcttggaaaagcttccctaaatagggcttagaggactgtccacctcatctttcatattttgctgctaacaatctaatacttcagatgcagaaccttcagtgttttagggcctttgagctgctgacacacaatagtgcatcagagctgcctctcagtgctccggtcacctacacagaagatgactgaaggaatgaaatgacgagttaattcccaggaagaaaatgaaactgggaacaaatgcattgcccaaattgagctgaccctcctccactaaggtttgaaaagaccctattaaagataccttccatgtgggcacgaggttggccaccaatcaagtagcctcttttgcctaatatccttggcaaatataaatttgttagcaacaggtctgaatgaaagagactgggtgggtcttgattcagaagagctgaattcactctgtgagtctgaagatacaagtcagcctccaggaatctttgcttagctggatagtgtgaaaatagatgatgatgggagtgaagatagaaagaggataaggactgatttgagggaagctggtaaggttcttctgtggctcctgaaatcacatcattagtaatgtcatctttgggtcttcagagctttttgtattacctatgggtataattaagcaactgggagggttgatactgttacatttcttagcttgtaccttctaaggtagttaacaccacacaggctgataactcagggcaagagagaggcctggagagttgacaagagtgtgaagatactggagaggggttcaaaataggatcaattcttctaatactattcttatttcttgctaataatttgtccttgtaattatagtgaagtaatggtctggatataaatgagatatggttttgtgaggaagaaacatagaggattattcttaacaactgtggcagccttgccaatatggaacccaatttcagagtttgtgaaatggtacaagtctcataaactatctcagcactgcatccgtatttgtgggcacctgtgccaaaagcaccttgatatgtttcttagtgtaattggccagagatggccaatagatgtcttctcaagtgtttttgatcaccaggtcagtgctattgggagtgatataatatggtggttcctaaagttatttttggtctctttttttttttttttttaagtgctatgatagattaacaacacctgccttggatgcaggaattaggtggggctgcacacgtgcatggtattttctatccctatgctaggttttgtttctgttggctgtcttcactagacttgagatgacttgatttacagtaatccctatgtgatgtaactagtctagaccttcccttctccgcaattcccagctccaggtttcagaaagtatgccacactcaacccttctctccagttcatcctgtattaatttcttcccatattaattcaaagggagtggacaggtccctggctgaaaagaaataaagagatcccc

SEQ ID NO: 4759 - DNA, 3315 bp, Homo sapiens
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 4760 - DNA, 3411 bp, Homo sapiens
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 4761 - DNA, 3432 bp, Homo sapiens
atgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatag

SEQ ID NO: 4762 - DNA, 8174 bp, Homo sapiens
gcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttcggcaggacgggcatcgtggtgccctgcaaggagggccagctgcgcgtcggcgagctcacccagcaggcgctgcagcggtacctgaagacccgggagaagggtcctggttactgggtgaagattcatcacttagaatatacagatggaggaatcctggatccagatgatgtcttggcagatgttgttgaagataaagacaagctgattgctgtgtttgaagaacaagaaccactccacaagattgagagccccagtggaaaccctgcagatcggcagagcccagatgcttttgagacagaagtggccgcccaactggccgcatttaagccaattggtggggagattgaagtaaccccttctgctctaaaactaggcactccactgctggtgaggagaagcagtgacccagtgccaggcccacctgctgatacccagccaagcgcttcacaccctggtggccagagtctgaaactggttgttccagattccacgcagaacttggaagacagagaagttttgaatggtgtacagacagaactactaacttcgccaagaactaaggacacattgagtgatatgacaagaacagtggagatttctggggaaggaggcccattgggaatacatgtagtgcccttcttttcatctctgagtggaaggattctaggactcttcatccgaggcattgaagacaacagcaggtccaagcgggagggactatttcacgaaaatgaatgtattgtaaaaatcaacaatgtggatctcgtagacaaaacctttgctcaggctcaagatgtcttccgccaggcaatgaaatctccaagtgtgctcctccacgtgcttcctccacaaaaccgtgaacagtatgaaaagtcagtcattggctctcttaacatttttggtaataatgatggcgttttgaaaaccaaagtgccgcctcctgtccatggaaaatcgggactaaagacagcaaatctcacaggaaccgatagtcctgaaacagatgcatcagcttccctgcaacaaaacaagagtccccgagtaccaaggctgggaggaaaaccatcctctccctcactctcgcctctcatgggatttggcagcaataaaaatgcaaagaaaattaagattgacctaaagaaaggccctgaaggacttggtttcactgtggttaccagagactcttccatacatggtcccggtcccatttttgtaaaaaacattttaccaaagggagcagcaataaaagatggccgcctacaatcaggggacagaattttggaggtaaatgggagagatgtcaccggacgaacccaggaagagcttgtggccatgctcaggagcaccaagcagggggagacagcatcgctggtcattgcccgccaagaaggacattttctgccccgagagttgaaaggagaacctgactgctgtgcactctctctggagacaagcgagcagctcacctttgagatccccctgaatgattcaggttctgctggcctcggggtgagcttaaaagggaacaaatccagagaaactggaacagacttggggatttttatcaaatccatcattcatggaggcgctgcttttaaggatggtcgtctgcgaatgaatgaccagctgattgcagttaatggggaatctcttttgggaaagtccaaccacgaagctatggaaacacttaggcggtcaatgtccatggagggaaacatccgagggatgatccagttggtgattctgaggaggccagagagaccaatggaggatcctgcagagtgtggggcattttccaagccatgctttgagaactgtcaaaatgctgtaaccacctctaggcgaaatgataatagtatcctgcatccacttggcacttgcagtccacaagacaaacagaaaggtctattgctgcccaatgacggatgggccgagagtgaagttccaccttctccaacaccacattctgctctgggattgggcctcgaagattacagccacagctctggggtggattcagcagtatattttccagatcagcacatcaacttcagatctgtgacaccggccaggcagcctgaatcaattaatttgaaagcctcgaagagcatggaccttgtgccagatgaaagcaaggttcactcattggctggacaaaaatcggaatctccaagcaaagattttggtccaactctgggtttgaaaaagtccagctccttggagagtctgcagactgcagtggccgaggtcaggaagaatgaccttccctttcacaggccccggccgcacatggttcgaggccgaggctgcaatgagagctttagagcagccattgacaaatcctacgatggacctgaagaaatagaagctgacggtctgtctgataagagctctcactctggccaaggagctctgaattgtgagtctgcccctcaggggaattcggagctagaggacatggaaaataaagccaggaaagtcaaaaaaacgaaagagaaggagaagaaaaaggaaaagggcaaattgaaagtcaaggagaaaaagcgcaaagaggagaatgaagatccagaaaggaaaataaagaagaagggcttcggcgccatgctgagatttggaaagaagaaagaggataagggtggaaaggctgagcagaaaggtactctgaaacatggtggcctgagagaagaagagctggagaaaatgaaagaagagcgtgaaaggattggagcaaaacatcaggagctaagggaaaagcaggcaagaggtcttcttgattatgctactggtgcaattggatcagtgtatgatatggatgatgatgaaatggaccccaattatgccagagtgaaccactttcgggaaccatgcacatcagcaaatgtctttagatctccatctccccctcgagctggaccatttggttaccctcgggatggccatccactgtctccagaaagagaccacttagagggtctctatgccaaggtcaacaagccataccatccactggttccagctgacagtggccgtcctacgggtggaagcactgaccgtatccagaagttgcggaaagagtattatcaggctcggagggaaggtttccctttatatgaagacgacgaaggaagagcaaggccatctgagtatgacctactctgggtgcctggaaggggtccagatgggaatgcacacaacctccgctttgaagggatggagaggcagtacgcatccttacccaggggaggacccgcagatcctgtagactatctgccagcagcacctcgggggctctacaaggaaagggagcttccctattatccaggggctcatcctatgcaccctcccaaagggagctatccccgccccacagagctcagggtggcagatctccggtatcctcagcactacccacccccgccagctccccagcacaaaggaccctttcgacaagacgttccgccttcccctccccagcaccaaagaatgccagcctatcaggaaacaggcagaccagggccccgtgggggcagcccagaccagtacccttaccgaacccaggattcccggcagaagaaccccatgactgcagccgtatagctgagtgccaccgaggccagcccggtccagaaaggaaggtgtctactctacctttgccctttctaaacctgaagacctccttggtgttaggaattctccatgttactgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccatggcctctgatgaccagcaggtattagatggaagtgaatgagagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaa
